United States Patent 11,920,167 (ENGINEERED GLYCOSYLTRANSFERASES AND STEVIOL GLYCOSIDE GLUCOSYLATION METHODS) - sequence listing, part 2

SEQ ID NO: 1451 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1452 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1453 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1454 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1455 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1456 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1457 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1458 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1459 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1460 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1461 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1462 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1463 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1464 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1465 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1466 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1467 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1468 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1469 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1470 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1471 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1472 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1473 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1474 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1475 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctgcatcgcgaatcacaggtcatggaacgctatctgcaaatgttccgccacctgcaatggcgcccgctggctcatgccgtaccgatggag

SEQ ID NO: 1476 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLHRESQVMERYLQMFRHLQWRPLAHAVPME

SEQ ID NO: 1477 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1478 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1479 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1480 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1481 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1482 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1483 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1484 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1485 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1486 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1487 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1488 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1489 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1490 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1491 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1492 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1493 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagatttttgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1494 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFCPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1495 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1496 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLAVEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1497 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1498 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1499 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttcgaagattttcgtccggttagcagtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1500 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFEDFRPVSSRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1501 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1502 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLALEELSTDEYLQAKEGLVGLGAEGEAVLTVDFRDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1503 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgccgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctgcatccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1504 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLHPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1505 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctggagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1506 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIWSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1507 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1508 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1509 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatcatgagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1510 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIMSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1511 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagagctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1512 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGELLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1513 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgggctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1514 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAGLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1515 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatcgagagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1516 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIESDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1517 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatcgctagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1518 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIASDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1519 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagtgatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1520 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1521 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1522 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1523 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcgcgtattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1524 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRAYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1525 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcgatctggctcatgccgtaccgatggag

SEQ ID NO: 1526 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRDLAHAVPME

SEQ ID NO: 1527 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtgagagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1528 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1529 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctggtgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1530 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLVSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1531 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagatctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1532 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGDLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1533 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtgcggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1534 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRADTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1535 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcagcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1536 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1537 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1538 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1539 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1540 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1541 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggaaggctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1542 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGRLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1543 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcgggtattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1544 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRGYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1545 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcagcgcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1546 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAARIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1547 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagaggttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1548 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEEVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1549 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctggcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1550 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLAMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1551 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagatgttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1552 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEDVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1553 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagattctcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1554 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1555 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctactctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1556 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1557 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctctagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1558 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRISSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1559 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatcaatagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1560 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRINSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1561 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgctcgtattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1562 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRSYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1563 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcatttcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1564 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAFRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1565 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagtgatcttccgtgatccgtggatggtttttgcgtggcgtccacgtccaggtgtttgggaatatgtgcgcattcatgtagaacagctggccctggaggagctgagcactgatgaatatctgcaagccaaagaaggccttgttggcttaggtgcagaaggtgaagcagttctgacggtggatttccgagattttcgtccggttagccgtcgtttacgcgacgagagcaccattggtgatggtcttacccatctgaatcgtcgtttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgttctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1566 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEVIFRDPWMVFAWRPRPGVWEYVRIHVEQLALEELSTDEYLQAKEGLVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAVLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1567 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1568 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVAERYTWERYAERLMTIARVFGFWRFVLDRESQVMERYLQMFRHLQWRPLAHAVPME

SEQ ID NO: 1569 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1570 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1571 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccggcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1572 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVEERYTWERYAERLMTIARVFGFWRFVLDRESQVMERYLQMFRHLQWRPLAHAVPME

SEQ ID NO: 1573 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagcagttctgacggtggatttcgaagattttcgtccggttagcccgcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcccgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1574 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLVVEELSTDEYLQAKEGLVGLGAEGEAVLTVDFEDFRPVSPRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARERPHYWLEISDAALARVEERYTWERYAERLMTIARVFGFWRFVLDRESQVMERYLQMFRHLQWRPLAHAVPME

SEQ ID NO: 1575 - DNA, 2379 bp, Artificial Sequence
  Variant of Sucrose Synthase
atgattgaagaactgcgccaacagctgctggatgatccgcgttcatggtatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagcagttctgacggtggatttcgaagattttcgtccggttagccggcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1576 - protein, 793 aa, Artificial Sequence
  Variant of Sucrose Synthase
MIEELRQQLLDDPRSWYAFLRHLVASQRDSWLQTDLQRACADFREQLPEGYDEDIGPLEDFVAHTQEAIFRDPWMVFAWRPRPGVWEYVRIHVEQLVVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARERPHYWEEISDAALARVAERYTWERYAERLMTIARVFGFWRFVLDRESQVMERYLQMFRHLQWRPLAHAVPME

SEQ ID NO: 1577 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccggcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcacgaatcacaggtcatggaacgctatctgcaaatgttccgccacctgcaatggcgcccgctggctcatgccgtaccgatggag

SEQ ID NO: 1578 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDHESQVMERYLQMFRHLQWRPLAHAVPME

SEQ ID NO: 1579 - DNA, 2379 bp, Artificial Sequence
  Variant of Sucrose Synthase
atgattgaagaactgcgccaacagctgctggatgatccgcgttcatggtacgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1580 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1581 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1582 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1583 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1584 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVEERYTWERYAERLMTIARVFGFWRFVLDRESQVMERYLQMFRHLQWRPLAHAVPME

SEQ ID NO: 1585 - DNA, 2379 bp, Artificial Sequence
  Variant of Sucrose Synthase
atgattgaagaactgcgccaacagctgctggatgatccgcgttcatggtatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggataacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcccgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1586 - protein, 793 aa, Artificial Sequence
  Variant of Sucrose Synthase
MIEELRQQLLDDPRSWYAFLRHLVASQRDSWLQTDLQRACADFREQLPEGYDEDIGPLEDFVAHTQEAIFRDPWMVFAWRPRPGVWEYVRIHVEQLVVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDNEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1587 - DNA, 2379 bp, Artificial Sequence
  Variant of Sucrose Synthase
atgattgaagaactgcgccaacagctgctggatgatccgcgttcatggtatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagcccgcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggataacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcccgtactgaagaacgcccatcatctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1588 - protein, 793 aa, Artificial Sequence
  Variant of Sucrose Synthase
MIEELRQQLLDDPRSWYAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSPRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDNEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1589 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1590 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLVVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARERPHYWLEISDAALARVAERYTWERYAERLMTIARVFGFWRFVLDRESQVMERYLQMFRHLQWRPLAHAVPME

SEQ ID NO: 1591 - DNA, 2379 bp, Artificial Sequence
  Variant of Sucrose Synthase
atgattgaagaactgcgccaacagctgctggatgatccgcgttcatggtatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccggcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattggcttgaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1592 - protein, 793 aa, Artificial Sequence
  Variant of Sucrose Synthase
MIEELRQQLLDDPRSWYAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWLEISDAALARVEERYTWERYAERLMTIARVFGFWRFVLDRESQVMERYLQMFRHLQWRPLAHAVPME

SEQ ID NO: 1593 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggataacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatacccgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccatgaagcgaccgcagaacgtctggccgacttcctggaagcagcgcgcaaacgtccgcactattggcttgaaattagcgatgcggctcttgcgcgcgtcgcagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1594 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDNEQDHHFACQFTADLIAMNAADIIVTSTYQEIAGNDREIGQYEGHQDYTLPGLYRVENGIDVFDSKFNIVSPGADPRFYFSYTRTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRHGGPLEIIEDGVSGFHIDPNDHEATAERLADFLEAARKRPHYWLEISDAALARVAERYTWERYAERLMTIARVFGFWRFVLDRESQVMERYLQMFRHLQWRPLAHAVPME

SEQ ID NO: 1595 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggccgtggaggagctgagcactgatgaatatctgcaagccaaagaaggccttgttggcttaggtgcagaaggtgaagcagttctgacggtggatttcgaagattttcgtccggttagccggcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttctattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1596 - protein, 793 aa, Artificial Sequence
  Variant of Sucrose Synthase
MIEELRQQLLDDPRSWDAFLRHLVASQRDSWLQTDLQRACADFREQLPEGYDEGIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRFYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVAERYTWERYAERLMTIARVFGFWRFVLDRESQVMERYLQMFRHLQWRPLAHAVPME

SEQ ID NO: 1597 - DNA, 2379 bp, Artificial Sequence
  Variant of Sucrose Synthase
atgattgaagaactgcgccaacagctgctggatgatccgcgttcatggtatgcattcctgcgtcatttagtcgcatctcagcgtgactcatggttacagacggatttacagcgcgcgtgcgcggattttcgcgaacagcttccggaaggctatgatgaaggtattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagcagttctgacggtggatttcgaagattttcgtccggttagcccgcgtttacgcgacgagagcaccattggtgatggtcttacccatctgaatcgtcatttagcaggtcgcatctttagcgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1598 - protein, 793 aa, Artificial Sequence
  Variant of Sucrose Synthase
MIEELRQQLLDDPRSWYAFLRHLVASQRDSWLQTDLQRACADFREQLPEGYDEGIGPLEDFVAHTQEAIFRDPWMVFAWRPRPGVWEYVRIHVEQLVVEELSTDEYLQAKEGLVGLGAEGEAVLTVDFEDFRPVSPRLRDESTIGDGLTHLNRHLAGRIFSDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADIRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1599 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatttcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1600 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLILSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1601 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatttcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtataccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgcttctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccattttgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcatgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1602 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQYTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHFDPNDHEATAERLADFLEAARERPHYWEEISDAALARVEERYTWERYAERMMTIARVFGFWRFVLDRESQVMERYLQMFRHLQWRPLAHAVPME

SEQ ID NO: 1603 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatttcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcatgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1604 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLILSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERMMTIARVFGFWRFVLDRESQVMERYLQMFRHLQWRPLAHAVPME

SEQ ID NO: 1605 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattgggtttcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtataccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggtcgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaacaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccattttgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcatgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1606 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWVSRFKVWPYLERYAQDLEREVLAELGSRPDLIIGNYSDGNLVATLLSEKLGVTQCNIAHALEKSKYLYSDLHWPDHEQDHHFACQYTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLLLSMARMDRIKNLSGLAELYGRSSRLRGLANLVIIGGHVDVGNSRDAEEREQIRRMHEIMDHYQLDGQLRWVGSLLDKTVAGELYRVVADGRGVFVQPALFEAFGLTVIEAMSSGLPVFATRFGGPLEIIEDGVSGFHFDPNDHEATAERLADFLEAARERPHYWEEISDAALARVEERYTWERYAERMMTIARVFGFWRFVLDRESQVMERYLQMFRHLQWRPLAHAVPME

SEQ ID NO: 1607 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatttcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgcttctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1608 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDHIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1609 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1610 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1611 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttggttgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1612 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILVATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1613 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgattctgtcgatggcccgtatggatcgtatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1614 - protein, 793 aa, Artificial Sequence; identical to SEQ ID NO: 1600
  Variant of Sucrose Synthase

SEQ ID NO: 1615 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgcttctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaacgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1616 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKNVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1617 - DNA, 2379 bp, Artificial Sequence
  Variant of Sucrose Synthase
atgattgaagaactgcgccaacagctgctggatgatccgaggtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccaggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtctgggttttgaaccaggttggggcaacaccgcgggccgtgttagcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgcggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1618 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRLGFEPGWGNTAGRVSETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1619 - DNA, 2379 bp, Artificial Sequence
  Variant of Sucrose Synthase
atgattgaagaactgcgccaacagctgctggatgatccggactcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtaaattacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcattatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgtatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagctgtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1620 - protein, 793 aa, Artificial Sequence
  Variant of Sucrose Synthase
MIEELRQQLLDDPDSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRKLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFHYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWELYAERLMTIARVFGFWRFVLDRESQVMERYLQMFRHLQWRPLAHAVPME

SEQ ID NO: 1621 - DNA, 2379 bp, Artificial Sequence
  Variant of Sucrose Synthase
atgattgaagaactgcgccaacagctgctggatgatccggactcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagctgtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1622 - protein, 793 aa, Artificial Sequence
  Variant of Sucrose Synthase
MIEELRQQLLDDPDSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDHIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWELYAERLMTIARVFGFWRFVLDRESQVMERYLQMFRHLQWRPLAHAVPME

SEQ ID NO: 1623 - DNA, 2379 bp, Artificial Sequence
  Variant of Sucrose Synthase
atgattgaagaactgcgccaacagctgctggatgatccgaggtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcggggttttgaaccaggttggggcaacaccgcgggccgtgttagcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1624 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVSETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1625 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtagattacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgagaattttgattgcgacccgtttaatcccggaaagtgatggcacgacttgtgaccagcgtctggagcctgtccatggtgccgagaatgtgcagattctgcgcgttccgtttcattatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1626 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFHYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDHIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1627 - DNA, 2379 bp, Artificial Sequence
  Variant of Sucrose Synthase
atgattgaagaactgcgccaacagctgctggatgatccgaggtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccaggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtagattacgcgacgagagcaccattggtgatggtcttacccatctgaatcgtcatttagcaggtacgatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtctgggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcattatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1628 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGTIFTDLAAGRSQILEFLSLHRLDGQNLMLSNGNTDFDSLRQTVQYLGTLPRETPWAEFREDMRRLGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFHYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1629 - DNA, 2379 bp, Artificial Sequence
  Variant of Sucrose Synthase
atgattgaagaactgcgccaacagctgctggatgatccggactcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtagattacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1630 - protein, 793 aa, Artificial Sequence
  Variant of Sucrose Synthase
MIEELRQQLLDDPDSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDHIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1631 - DNA, 2379 bp, Artificial Sequence
  Variant of Sucrose Synthase
atgattgaagaactgcgccaacagctgctggatgatccgaggtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtaaattacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgaaaattttgattgcgacccgtttaatcccggaaagtgatggcacgacttgtgaccagcggctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1632 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRKLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPKILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDHIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1633 - DNA, 2379 bp, Artificial Sequence
  Variant of Sucrose Synthase
atgattgaagaactgcgccaacagctgctggatgatccgaggtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccaggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtagattacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcggggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgaaaattttgattgcgacccgtttaatcccggaaagtgatggcacgacttgtgaccagcggctggagcctgtccatggtgccgagaatgtgcagattctgcgcgttccgtttcattatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgtatcaagaacctgagcggtctggccgaactgtatggtcggagttctcgcttacgcggtctggccaatttggtgatcatcggtggtcatgttgatgtgggcaatagtagcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcggtatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1634 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPKILIATRLIPESDGTTCDQRLEPVHGAENVQILRVPFHYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSSDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1635 - DNA, 2379 bp, Artificial Sequence
  Variant of Sucrose Synthase
atgattgaagaactgcgccaacagctgctggatgatccgcgttcatgggatgcattcctgcgtcatttagtcgcagagcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagaagaaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggaagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggaacgacttgtgaccagcgtctggagcctgtccatggtgccgagaatgtgcagattctgcgcgttccgtttcgctatgaggatggtcgtattcacccgcactggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctgaattacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1636 - protein, 793 aa, Artificial Sequence
  Variant of Sucrose Synthase
MIEELRQQLLDDPRSWDAFLRHLVAEQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLEEGRSQILEFLSLHRLDGQNLMLSNGNTDFDSLRQTVQYLGTLPRETPWEEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSELRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1637 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgtttacgtggtctggccaatttggtgatcatcggtggtcatgttgatgtgggcaatagtcgcgatgaagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1638 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDEEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1639 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggaagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccggaatggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgagcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgtttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagaaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1640 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWEEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPEWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADERTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEETAERLADFLEAARERPHYWEEISDAALARVEERYTWERYAERLMTIARVFGFWRFVLDRESQVMERYLQMFRHLQWRPLAHAVPME

SEQ ID NO: 1641 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtgaaatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggaagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatgaaacgacttgtgaccagcgtctggagcctgtccatggtgccgagaatgtgcagattctgcgcgttccgtttcgctatgaggatggtcgtattcacccgcactggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgaagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1642 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGEIFTDLAAGRSQILEFLSLHRLDGQNLMLSNGNTDFDSLRQTVQYLGTLPRETPWEEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDETTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDEEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1643 - DNA, 2379 bp, Artificial Sequence
  Variant of Sucrose Synthase
atgattgaagaactgcgccaacagctgctggatgatccgcgttcatgggatgcattcctgcgtcatttagtcgcagagcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggaacgacttgtgaccagcgtctggagcctgtccatggtgccgagaatgtgcagattctgcgcgttccgtttcgctatgaggatggtcgtattcacccggaatggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1644 - protein, 793 aa, Artificial Sequence
  Variant of Sucrose Synthase
MIEELRQQLLDDPRSWDAFLRHLVAEQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPEWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1645 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagaagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggaacgacttgtgaccagcgtctggagcctgtccatggtgccgagaatgtgcagattctgcgcgttccgtttcgctatgaggatggtcgtattcacccgcactggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagaaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1646 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGRIFTDLEAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEETAERLADFLEAARERPHYWEEISDAALARVEERYTWERYAERLMTIARVFGFWRFVLDRESQVMERYLQMFRHLQWRPLAHAVPME

SEQ ID NO: 1647 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagcagaaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgcgaacagggtgttgatgtggagccgcgcattttgattgcgacccgtttaatcccggaaagtgatggaacgacttgtgaccagcgtctggagcctgtccatggtgccgagaatgtgcagattctgcgcgttccgtttcgctatgaggatggtcgtattcacccgcactggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgtttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1648 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAEGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLREQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1649 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgcgaacagggtgttgatgtggagccgcgcattttgattgcgacccgtttaatcccggaaagtgatgaaacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgtttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1650 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLREQGVDVEPRILIATRLIPESDETTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1651 - DNA, 2379 bp, Artificial Sequence
  Variant of Sucrose Synthase
atgattgaagaactgcgccaacagctgctggatgatccgcgttcatgggatgcattcctgcgtcatttagtcgcaagtcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagcagttctgacggtggatttcgaagattttcgtccggttagccgtcgtttacgcgacgagagcaccattggtgatggtcttacccatctgaatcgtcatttagcaggtcgtatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggaagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccggaatggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccagaccacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgagcgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgtttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcaaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1652 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWEEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPEWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADERTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1653 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgggctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1654 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAGLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1655 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctggtgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1656 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLVSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1657 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggaagtctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1658 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1659 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgtgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcggttattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1660 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAVLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRGYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1661 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgtgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1662 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAVLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1663 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctggtgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1664 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLVSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1665 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagaactgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1666 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGELLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1667 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctagagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacttattttagctatgcccgtactgaagaacgcccatcgtctctggagccagaaatcgaaagtctgctgtttggccgcgaaccaggtgcagatagacgtggtgttctcgaagatcgccagaaaccgctgctggtgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggaaggctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1668 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLVSMARMDRIKNLSGLAELYGRSSRLRGLANLVIIGGHVDVGNSRDAEEREEIRRMHEIMDHYQLDGQLRWVGRLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1669 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcagctcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1670 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAARIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1671 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctacgctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagacctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggcccttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1672 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPATLESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRLYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGDLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1673 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1674 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1675 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttactgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagataggcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1676 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIFTDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1677 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1678 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1679 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatcattaccgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacatgatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1680 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIITDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAHDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1681 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatcatgactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1682 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIMTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1683 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatcatgcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1684 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1685 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttactgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1686 - protein, 793 aa, Artificial Sequence; identical to SEQ ID NO: 1676
  Variant of Sucrose Synthase

SEQ ID NO: 1687 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1688 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1689 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1690 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1691 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatcatgactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1692 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1693 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1694 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1695 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1696 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1697 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1698 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1699 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1700 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1701 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1702 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1703 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatcatgcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1704 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIMQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1705 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttactgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1706 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1707 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1708 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1709 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttaccgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1710 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1711 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1712 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1713 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1714 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1715 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1716 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1717 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttaccgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1718 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1719 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1720 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1721 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatcatgcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaagttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1722 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1723 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1724 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1725 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatcatgactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1726 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1727 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1728 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1729 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatcatgcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1730 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1731 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctttactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1732 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1733 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1734 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1735 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctggcaggatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1736 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIWQDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1737 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1738 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1739 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggcaggatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1740 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWQDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1741 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1742 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1743 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgtgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1744 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALVRVEERYTWERYAERLMTIARVFGFWRFVLDRESQVMERYLQMFRHLQWRPLAHAVPME

SEQ ID NO: 1745 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctggactgatttagcagcaggtgaaagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagataggcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1746 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGESQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1747 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatcatgactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1748 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIMTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1749 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1750 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1751 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagataggcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1752 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1753 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1754 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1755 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctggcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1756 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIWQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1757 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttcaggatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1758 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFQDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1759 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1760 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1761 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccataaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1762 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHKATAERLADFLEAARERPHYWEEISDAALARVEERYTWERYAERLMTIARVFGFWRFVLDRESQVMERYLQMFRHLQWRPLAHAVPME

SEQ ID NO: 1763 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1764 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1765 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagcagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatatgcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1766 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADMRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1767 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagaagttctgacggtggatttcgaagattttcgtccggttagccgtcgtttacgcgacgagagcaccattggtgatggtcttacccatctgaatcgtcatttagcaggtcgcatctttaccgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1768 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEEVLTVDFEDFRPVSRRLRDESTIGDGLTHLNRHLAGRIFTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADSRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1769 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagatgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1770 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEDVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1771 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatcatgactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttatgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcacaggatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatagacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgctgctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1772 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIMTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVMGRPDTGGQVVYILDQARALEREMRNRLRQQGVDVEPRILIATRLIPESDGTTCDQRLEPVHGAENVQILRVPFRYEDGRIHPHWISRFKVWPYLERYAQDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGSLLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1773 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccattgatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1774 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1775 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1776 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1777 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaaatgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1778 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAEMYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1779 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttctttattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1780 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFFIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1781 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgtgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtatctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1782 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSYLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1783 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgacatggaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1784 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDMEATAERLADFLEAARERPHYWEEISDAALARVEERYTWERYAERLMTIARVFGFWRFVLDRESQVMERYLQMFRHLQWRPLAHAVPME

SEQ ID NO: 1785 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1786 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1787 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1788 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1789 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattttggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatatcgttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcatatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1790 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNIVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDHIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1791 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggagcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattttggatcaggcccgagcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctcgttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1792 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1793 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttagaagcagaaggtgaagatgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcctgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctcgttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtatgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1794 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLEAEGEDVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESMLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1795 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgagcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatactgttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1796 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNTVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1797 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggacagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtgcggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgacatggaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1798 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDMEATAERLADFLEAARERPHYWEEISDAALARVEERYTWERYAERLMTIARVFGFWRFVLDRESQVMERYLQMFRHLQWRPLAHAVPME

SEQ ID NO: 1799 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggacagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaaatgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1800 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAEMYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1801 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1802 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1803 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1804 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1805 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtgatccatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggacagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtgcggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1806 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVIHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGADQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1807 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1808 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1809 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagagatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaaatgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1810 - protein, 793 aa, Artificial Sequence; identical to SEQ ID NO: 1778
  Variant of Sucrose Synthase

SEQ ID NO: 1811 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggacagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttctttattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1812 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFFIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1813 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaacgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgacatggaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1814 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDMEATAERLADFLEAARERPHYWEEISDAALARVEERYTWERYAERLMTIARVFGFWRFVLDRESQVMERYLQMFRHLQWRPLAHAVPME

SEQ ID NO: 1815 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1816 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1817 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1818 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDGQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDHEATAERLADFLEAARERPHYWEEISDAALARVEERYTWERYAERLMTIARVFGFWRFVLDRESQVMERYLQMFRHLQWRPLAHAVPME

SEQ ID NO: 1819 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggatggtcagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccacttatcgaaagtctgctgtttggccgcgaaccaggtgcagatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccatgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1820 - protein, 793 aa, Artificial Sequence; identical to SEQ ID NO: 1774
  Variant of Sucrose Synthase

SEQ ID NO: 1821 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatatccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1822 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDIRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1823 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtatctggagccagaaatcgaaagtctgctgtttggccgcgaaccaggtccggatatccgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaacgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttcttcattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1824 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSYLEPEIESLLFGREPGPDIRGVLEDRQKPLLLSMARMDRIKNLSGLAELYGRSSRLRGLANLVIIGGHVDVGNSRDAEEREEIRRMHEIMDHYQLDGQLRWVGSQLDKNVAGELYRVVADGRGVFVQPALFEAFGLTVIEAMSSGLPVFATRFGGPLEIIEDGVSGFFIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1825 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1826 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1827 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaacgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1828 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRGLANLVIIGGHVDVGNSRDAEEREEIRRMHEIMDHYQLDGQLRWVGSQLDKNVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1829 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtatctggagccagaaatcgaaagtctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1830 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1831 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1832 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1833 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcactggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccactaatcgaaagtctgctgtttggccgcgaaccaggtccggatcagcgtggtgttctcgaagatcgccagaaaccgctgcttctgtcgatggcccgtatggatcgcatcaagaacctgagcggtctggccgaaatgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1834 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLLLSMARMDRIKNLSGLAEMYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1835 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccagaaatcgaaagtctgctgtttggccgcgaaccaggtccggatatccgtggtgttctcgaagatcgccagaaaccgctgcttctgtcgatggcccgtatggatcgcatcaagaacctgagcggtctggccgaaatgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1836 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDIRGVLEDRQKPLLLSMARMDRIKNLSGLAEMYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1837 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtctctggagccactaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1838 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPLIESLLFGREPGPDQRGVLEDRQKPLILSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1839 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1840 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1841 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtatctggagccagaaatcgaaagtctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1842 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSYLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1843 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaacgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtatctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1844 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1845 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccgcgcacgtattttagctatgcccgtactgaagaacgcccatcgtatctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaacgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1846 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRTYFSYARTEERPSYLEPEIESLLFGREPGPDQRGVLEDRQKPLILSMARMDRIKNLSGLAELYGRSSRLRGLANLVIIGGHVDVGNSRDAEEREEIRRMHEIMDHYQLDGQLRWVGSQLDKNVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1847 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1848 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLILSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1849 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgagtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatatccgtggtgttctcgaagatcgccagaaaccgctgattctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccacattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1850 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVLAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDIRGVLEDRQKPLILSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1851 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctgggggaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1852 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLGELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1853 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaagcgctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1854 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIEALLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1855 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacaagtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1856 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYKYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1857 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccaggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1858 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1859 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttggctttatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1860 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWLYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1861 - DNA, 2379 bp, Artificial Sequence
  Variant of Sucrose Synthase
atgattgaagaactgcgccaacagctgctggatgataagcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1862 - protein, 793 aa, Artificial Sequence
  Variant of Sucrose Synthase
MIEELRQQLLDDKRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1863 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggctcgcgaatcacaggtcatggaacgctatctgcaaatgttccgccacctgcaatggcgcccgctggctcatgccgtaccgatggag

SEQ ID NO: 1864 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLARESQVMERYLQMFRHLQWRPLAHAVPME

SEQ ID NO: 1865 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacggcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1866 - protein, 793 aa, Artificial Sequence
  Variant of Sucrose Synthase
MIEELRQQLLDDPRSWDAFLRHLVASQRDSWLQTDLRRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1867 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcatattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1868 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVHIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1869 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaactgtttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1870 - protein, 793 aa, Artificial Sequence
  Variant of Sucrose Synthase
MIEELRQQLLDDPRSWDAFLRHLVASQRDSWLQTDLQRACADFREQLPEGYDEDIGPLELFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1871 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccaacttctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1872 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPTSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1873 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttagggcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1874 - protein, 793 aa, Artificial Sequence
  Variant of Sucrose Synthase
MIEELRQQLLDDPRSWDAFLRHLVASQRDSWLQTDLGRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1875 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaacggctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1876 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIERLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1877 - DNA, 2379 bp, Artificial Sequence
  Variant of Sucrose Synthase
atgattgaagaactgcgccaacagctgctggatgatccgcgttcatggcgggcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1878 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1879 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagagtgaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1880 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLESEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1881 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1882 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSHDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1883 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcgcttgaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1884 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLALEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1885 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1886 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1887 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggttggctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1888 - protein, 793 aa, Artificial Sequence
  Variant of Sucrose Synthase
MIEELRQQLLDDPRSWDAFLRHLVASQRDSWLQTDLQRACADFREQLPEGYDEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1889 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagcatgaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1890 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEHEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1891 - DNA, 2379 bp, Artificial Sequence
  Variant of Sucrose Synthase
atgattgaagaactgcgccaacagctgctggatgatcatcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1892 - protein, 793 aa, Artificial Sequence
  Variant of Sucrose Synthase
MIEELRQQLLDDHRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1893 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattggaaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1894 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWKEISDAALARVEERYTWERYAERLMTIARVFGFWRFVLDRESQVMERYLQMFRHLQWRPLAHAVPME

SEQ ID NO: 1895 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtcattgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1896 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGHWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1897 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtgctgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1898 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSADAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1899 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatagggtaccgatggag

SEQ ID NO: 1900 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHRVPME

SEQ ID NO: 1901 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcataatgtaccgatggag

SEQ ID NO: 1902 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHNVPME

SEQ ID NO: 1903 - DNA, 2379 bp, Artificial Sequence
  Variant of Sucrose Synthase
atgattgaagaactgcgccaacagctgctggatgatccgcgttcatgggatggattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcggaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1904 - protein, 793 aa, Artificial Sequence
  Variant of Sucrose Synthase
MIEELRQQLLDDPRSWDGFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1905 - DNA, 2379 bp, Artificial Sequence
  Variant of Sucrose Synthase
atgattgaagaactgcgccaacagctgctggatgataatcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1906 - protein, 793 aa, Artificial Sequence
  Variant of Sucrose Synthase
MIEELRQQLLDDNRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1907 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaacatttaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1908 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEHLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1909 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccacggtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1910 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPRSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1911 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaaaagctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1912 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAEKLADFLEAARERPHYWEEISDAALARVEERYTWERYAERLMTIARVFGFWRFVLDRESQVMERYLQMFRHLQWRPLAHAVPME

SEQ ID NO: 1913 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcaggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1914 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSQDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1915 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtctggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1916 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSLDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1917 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1918 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSMDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1919 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtattgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1920 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSIDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1921 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatccggaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1922 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1923 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctattgggaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1924 - protein, 793 aa, Artificial Sequence
  Variant of Sucrose Synthase
MIEELRQQLLDDPRSWDAFLRHLVASQRDSWLQTDLQRACADFREQLPEGYWEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1925 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgaccattggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1926 - protein, 793 aa, Artificial Sequence
  Variant of Sucrose Synthase
MIEELRQQLLDDPRSWDAFLRHLVASQRDHWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1927 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1928 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1929 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtaatgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1930 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1931 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcaaaggtcatggaacgctatctgcaaatgttccgccacctgcaatggcgcccgctggctcatgccgtaccgatggag

SEQ ID NO: 1932 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESKVMERYLQMFRHLQWRPLAHAVPME

SEQ ID NO: 1933 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcggggattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1934 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1935 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatagggaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1936 - protein, 793 aa, Artificial Sequence
  Variant of Sucrose Synthase
MIEELRQQLLDDPRSWDAFLRHLVASQRDSWLQTDLQRACADFREQLPEGYREDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1937 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtgattgagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1938 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVIELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1939 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgctgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1940 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFADFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1941 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacccttattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1942 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYPYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1943 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcgacgcgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1944 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYATRLMTIARVFGFWRFVLDRESQVMERYLQMFRHLQWRPLAHAVPME

SEQ ID NO: 1945 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttaacggcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1946 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLTAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1947 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagggaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1948 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEGTAERLADFLEAARERPHYWEEISDAALARVEERYTWERYAERLMTIARVFGFWRFVLDRESQVMERYLQMFRHLQWRPLAHAVPME

SEQ ID NO: 1949 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtcggctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1950 - protein, 793 aa, Artificial Sequence
  Variant of Sucrose Synthase
MIEELRQQLLDDPRSWDAFLRHLVASQRDSWLQTDLQRACADFREQLPEGYDEDIGRLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1951 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatccggaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1952 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDPEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1953 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtggtgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1954 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGGEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1955 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggaggcggaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1956 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEAEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1957 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcctaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1958 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1959 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcaagggtcatggaacgctatctgcaaatgttccgccacctgcaatggcgcccgctggctcatgccgtaccgatggag

SEQ ID NO: 1960 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESRVMERYLQMFRHLQWRPLAHAVPME

SEQ ID NO: 1961 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagcctctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1962 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQPLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1963 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttcggggatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1964 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFGDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1965 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtgtggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1966 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSVDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1967 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcacggattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1968 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1969 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttaagtgcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1970 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLSAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1971 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttagggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1972 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVRAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1973 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgtggtggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1974 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPWWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1975 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatggggaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1976 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1977 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgttcgctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1978 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1979 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtctcggaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1980 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 1981 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgagtcgcgaatcacaggtcatggaacgctatctgcaaatgttccgccacctgcaatggcgcccgctggctcatgccgtaccgatggag

SEQ ID NO: 1982 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 1983 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcacgtattttagctatgcccgtactgaagaacgcccagcttctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgtgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 1984 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADPRTYFSYARTEERPASLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFVTRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1985 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 1986 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 1987 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 1988 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 1989 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 1990 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 1991 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 1992 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 1993 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 1994 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 1995 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaggctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 1996 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 1997 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 1998 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 1999 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2000 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2001 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2002 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2003 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcatggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2004 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGHGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2005 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2006 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2007 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2008 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2009 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2010 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2011 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2012 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2013 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2014 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2015 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2016 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2017 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2018 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2019 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2020 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2021 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccagctgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2022 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPAVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2023 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgatcaccaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2024 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMITNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2025 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2026 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2027 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2028 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2029 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2030 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2031 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2032 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWHYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2033 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2034 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2035 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2036 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2037 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2038 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2039 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2040 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2041 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2042 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2043 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccagctgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2044 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPAVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2045 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2046 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2047 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2048 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2049 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2050 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2051 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2052 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2053 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2054 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2055 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2056 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2057 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2058 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGNEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2059 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2060 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2061 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2062 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2063 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2064 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2065 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2066 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2067 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2068 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2069 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2070 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2071 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2072 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2073 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2074 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2075 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2076 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWHYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2077 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2078 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2079 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2080 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2081 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2082 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2083 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2084 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2085 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2086 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2087 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2088 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2089 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2090 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2091 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2092 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGNEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2093 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2094 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2095 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2096 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2097 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2098 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2099 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttttgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2100 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2101 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2102 - protein, 793 aa, Artificial Sequence
  Variant of Sucrose Synthase
MIEELRQQLLDDPRSWDAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2103 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2104 - protein, 793 aa, Artificial Sequence
  Variant of Sucrose Synthase
MIEELRQQLLDDPRSWDAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2105 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2106 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2107 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatggcgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2108 - protein, 793 aa, Artificial Sequence
  Variant of Sucrose Synthase
MIEELRQQLLDDPRSWRAFLRHLVASQRDSWLQTDLQRACADFREQLPEGYGEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2109 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctggaccgcgaatcacaggtcatggaacgctatctgcaaatgttccgccacctgcaatggcgcccgctggctcatgccgtaccgatggag

SEQ ID NO: 2110 - protein, 793 aa, Artificial Sequence
  Variant of Sucrose Synthase
MIEELRQQLLDDPRSWRAFLRHLVASQRDSWLQTDLQRACADFREQLPEGYDEDIGPLEDFVAHTQEAIFRDPWMVFAWRPRPGVWHYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLDRESQVMERYLQMFRHLQWRPLAHAVPME

SEQ ID NO: 2111 - DNA, 2379 bp, Artificial Sequence
  Variant of Sucrose Synthase
atgattgaagaactgcgccaacagctgctggatgatccgcgttcatgggacgcattcctgcgtcatttagtcgcatctcagcgtgactcatggttacagacggatttacagcgcgcgtgcgcggattttcgcgaacagcttccggaaggctatgacgaagatattggtccgctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtaacgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttttagccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2112 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWHYVRIHVEQLAVEELSTDEYLQAKEGLVGLGNEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLSRESQVMERYLQMFRHLQWRPLAHAVPME

SEQ ID NO: 2113 - DNA, 2379 bp, Artificial Sequence
  Variant of Sucrose Synthase
atgattgaagaactgcgccaacagctgctggatgatccgaagtcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2114 - protein, 793 aa, Artificial Sequence
  Variant of Sucrose Synthase
MIEELRQQLLDDPKSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2115 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggtgggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2116 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREVGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2117 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgtatattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2118 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPYISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2119 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagttatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2120 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREVMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2121 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtgcgttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2122 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2123 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggataggcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2124 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDRRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2125 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgtggccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaaaaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2126 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLWPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEKRYTWERYAERLMTIARVFGFWRFVLDRESQVMERYLQMFRHLQWRPLAHAVPME

SEQ ID NO: 2127 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgcataatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2128 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVHNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2129 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcaatgattttgtggcacatacccaggaagcgatcttccgtaatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2130 - protein, 793 aa, Artificial Sequence
  Variant of Sucrose Synthase
MIEELRQQLLDDPRSWDAFLRHLVASQRDSWLQTDLQRACADFREQLPEGYDEDIGPLNDFVAHTQEAIFRNPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2131 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttatctacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2132 - protein, 793 aa, Artificial Sequence
  Variant of Sucrose Synthase
MIEELRQQLLDDPRSWDAFLRHLVASQRDSWLSTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2133 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccgcctagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2134 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPPSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2135 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtattcgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2136 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRIRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2137 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtcatcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2138 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGHRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2139 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggcgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2140 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPASRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2141 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccatgttaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2142 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAMLGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2143 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacagtcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2144 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHSHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2145 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcgttccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2146 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLRSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2147 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtatgcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2148 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPYAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2149 - DNA, 2379 bp, Artificial Sequence
  Variant of Sucrose Synthase
atgattgaagaactgcgccaacagctgctggatgatccgcgtatttgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2150 - protein, 793 aa, Artificial Sequence
  Variant of Sucrose Synthase
MIEELRQQLLDDPRIWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2151 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatactgagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2152 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDTEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2153 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttttcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2154 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2155 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattggggtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2156 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIGVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2157 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctggggctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2158 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2159 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatctgcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2160 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADLRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2161 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgcggccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2162 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLRPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2163 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgagtaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2164 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVSNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2165 - DNA, 2379 bp, Artificial Sequence
  Variant of Sucrose Synthase
atgattgaagaactgcgccaacagctgctggatgatccgcgttcatgggatgcattcctgcgtcatttagtcgcaattcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2166 - protein, 793 aa, Artificial Sequence
  Variant of Sucrose Synthase
MIEELRQQLLDDPRSWDAFLRHLVAIQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2167 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtaggttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2168 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRRLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2169 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatagttatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2170 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDSYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2171 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctccgggattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2172 - protein, 793 aa, Artificial Sequence
  Variant of Sucrose Synthase
MIEELRQQLLDDPRSWDAFLRHLVASQRDSWLQTDLQRACADFREQLPEGYDEDIGPLRDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2173 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaatattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctggggaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2174 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEYFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2175 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtggggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2176 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLWGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2177 - DNA, 2379 bp, Artificial Sequence
  Variant of Sucrose Synthase
atgattgaagaactgcgccaacagctgctggatgatccgcgttcatgggatgcattcctgcgtcatttagtcgcagagcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2178 - protein, 793 aa, Artificial Sequence
  Variant of Sucrose Synthase
MIEELRQQLLDDPRSWDAFLRHLVAEQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2179 - DNA, 2379 bp, Artificial Sequence
  Variant of Sucrose Synthase
atgattgaagaactgcgccaacagctgctggatgatccgcgtccttgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2180 - protein, 793 aa, Artificial Sequence
  Variant of Sucrose Synthase
MIEELRQQLLDDPRPWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2181 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtatcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2182 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAYRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2183 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtttgcgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2184 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2185 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcactgggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2186 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLALGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2187 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtggtcgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2188 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRGRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2189 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtgagcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2190 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGREHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2191 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtggctaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2192 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVANSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2193 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgtggccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2194 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLWPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2195 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggattctcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2196 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADSRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2197 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaaacgatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2198 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFRETMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2199 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagcgatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2200 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREAMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2201 - DNA, 2379 bp, Artificial Sequence
  Variant of Sucrose Synthase
atgattgaagaactgcgccaacagctgctggatgatccgcgttcatgggatgcattcatgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2202 - protein, 793 aa, Artificial Sequence
  Variant of Sucrose Synthase
MIEELRQQLLDDPRSWDAFMRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2203 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgtctattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2204 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPSILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2205 - DNA, 2379 bp, Artificial Sequence
  Variant of Sucrose Synthase
atgattgaagaactgcgccaacagctgctggatgatccgcgtgcgtgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2206 - protein, 793 aa, Artificial Sequence
  Variant of Sucrose Synthase
MIEELRQQLLDDPRAWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2207 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctctgggattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2208 - protein, 793 aa, Artificial Sequence
  Variant of Sucrose Synthase
MIEELRQQLLDDPRSWDAFLRHLVASQRDSWLQTDLQRACADFREQLPEGYDEDIGPLWDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2209 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctctcggattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2210 - protein, 793 aa, Artificial Sequence
  Variant of Sucrose Synthase
MIEELRQQLLDDPRSWDAFLRHLVASQRDSWLQTDLQRACADFREQLPEGYDEDIGPLSDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2211 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatacgcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2212 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADTRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2213 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtactctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2214 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRTLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2215 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaaaatatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2216 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFRENMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2217 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtgagttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2218 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRELAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2219 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2220 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLGSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2221 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaagtgcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2222 - protein, 793 aa, Artificial Sequence
  Variant of Sucrose Synthase
MIEELRQQLLDDPRSWDAFLRHLVASQRDSWLQTDLQRACADFREVLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2223 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacgtcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2224 - protein, 793 aa, Artificial Sequence
  Variant of Sucrose Synthase
MIEELRQQLLDDPRSWDAFLRHLVASQRDSWLQTDLQRACADFRERLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2225 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgcatcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2226 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAHRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2227 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataagcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2228 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADKRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2229 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacatacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgttgtttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2230 - protein, 793 aa, Artificial Sequence
  Variant of Sucrose Synthase
MIEELRQQLLDDPRSWDAFLRHLVASQRDSWLHTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRCLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2231 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgagtattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2232 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPSISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2233 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcaattggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2234 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAIGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2235 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatactgaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2236 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHTEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2237 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtggagaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2238 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVENSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2239 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcggattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2240 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVRILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2241 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2242 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2243 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgttgccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2244 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLLPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2245 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggggccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2246 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLGPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2247 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctctgtgattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2248 - protein, 793 aa, Artificial Sequence
  Variant of Sucrose Synthase
MIEELRQQLLDDPRSWDAFLRHLVASQRDSWLQTDLQRACADFREQLPEGYDEDIGPLCDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2249 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggtggagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2250 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWVEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2251 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttaccgacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2252 - protein, 793 aa, Artificial Sequence
  Variant of Sucrose Synthase
MIEELRQQLLDDPRSWDAFLRHLVASQRDSWLPTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2253 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaaactcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2254 - protein, 793 aa, Artificial Sequence
  Variant of Sucrose Synthase
MIEELRQQLLDDPRSWDAFLRHLVASQRDSWLQTDLQRACADFRETLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2255 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgaagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2256 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLKPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2257 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgcggattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2258 - protein, 793 aa, Artificial Sequence
  Variant of Sucrose Synthase
MIEELRQQLLDDPRSWDAFLRHLVASQRDSWLQTDLQRACADFREQLPEGYDEDIGPLADFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2259 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaaattcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2260 - protein, 793 aa, Artificial Sequence
  Variant of Sucrose Synthase
MIEELRQQLLDDPRSWDAFLRHLVASQRDSWLQTDLQRACADFREILPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2261 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgatggaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2262 - protein, 793 aa, Artificial Sequence
  Variant of Sucrose Synthase
MIEELRQQLLDDPRSWDAFLRHLVASQRDSWLQTDLQRACADFREQLPEGYDEDIGPMEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2263 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgacgccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2264 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLTPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2265 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaacgttatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2266 - protein, 793 aa, Artificial Sequence
  Variant of Sucrose Synthase
MIEELRQQLLDDPRSWDAFLRHLVASQRDSWLQTDLQRACADFREQLPERYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2267 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatcggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2268 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADRRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2269 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggaggggttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2270 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALEGFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2271 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggtggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgttcgttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2272 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLVVEELSTDEYLQAKEGLVGLGAEGEAVLTVDFEDFRPVSRRLRDESTIGDGLTHLNRSLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2273 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatcatgagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2274 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDHEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2275 - DNA, 2379 bp, Artificial Sequence
  Variant of Sucrose Synthase
atgattgaagaactgcgccaacagctgctggatgatccgcgttcatgggatgcattcctgcgtcatttatcggcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2276 - protein, 793 aa, Artificial Sequence
  Variant of Sucrose Synthase
MIEELRQQLLDDPRSWDAFLRHLSASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2277 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatgagcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2278 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDERIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2279 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtccagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2280 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVQNGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2281 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatgatcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2282 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDDRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2283 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgacgattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2284 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVTILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2285 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgactctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2286 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLTLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2287 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgcagaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2288 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVQNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2289 - DNA, 2379 bp, Artificial Sequence
  Variant of Sucrose Synthase
atgattgaagaactgcgccaacagctgctggatgatccgcgttcatgggatgtattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtgctcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2290 - protein, 793 aa, Artificial Sequence
  Variant of Sucrose Synthase
MIEELRQQLLDDPRSWDVFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRAHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2291 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgttctttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2292 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRSLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2293 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactactgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2294 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTTEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2295 - DNA, 2379 bp, Artificial Sequence
  Variant of Sucrose Synthase
atgattgaagaactgcgccaacagctgctggatgatccgcgttcatgggatgcattcctgcgtcatttagtcgcagcgcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2296 - protein, 793 aa, Artificial Sequence
  Variant of Sucrose Synthase
MIEELRQQLLDDPRSWDAFLRHLVAAQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2297 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaagggcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2298 - protein, 793 aa, Artificial Sequence
  Variant of Sucrose Synthase
MIEELRQQLLDDPRSWDAFLRHLVASQRDSWLQTDLQRACADFREGLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2299 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttactgacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2300 - protein, 793 aa, Artificial Sequence
  Variant of Sucrose Synthase
MIEELRQQLLDDPRSWDAFLRHLVASQRDSWLLTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2301 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaatcgatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2302 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFRESMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2303 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcaactggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2304 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLATGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2305 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtggatattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2306 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVDILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2307 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaaatgattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2308 - protein, 793 aa, Artificial Sequence
  Variant of Sucrose Synthase
MIEELRQQLLDDPRSWDAFLRHLVASQRDSWLQTDLQRACADFREQLPEGYDEMIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2309 - DNA, 2379 bp, Artificial Sequence
  Variant of Sucrose Synthase
atgattgaagaactgcgccaacagctgctggatgatccgcgttcatgggatgcattcctgcgtcatttagtcgcaactcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2310 - protein, 793 aa, Artificial Sequence
  Variant of Sucrose Synthase
MIEELRQQLLDDPRSWDAFLRHLVATQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2311 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcctgaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2312 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVLNGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2313 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgcttctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2314 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLLLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2315 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgaagattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaacagatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2316 - protein, 793 aa, Artificial Sequence
  Variant of Sucrose Synthase
MIEELRQQLLDDPRSWDAFLRHLVASQRDSWLQTDLQRACADFREQLPEGYDEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREQMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2317 - DNA, 2379 bp, Artificial Sequence
  Variant of Sucrose Synthase
atgattgaagaactgcgccaacagctgctggatgatccgcgttcatgggatgcattcctgcgtcatttagtcgcatctcagcgtgactcatggttacagacggatttacagcgcgcgtgcgcggattttcgcgaacagcttccggaaggctatgatgaagatattggtccgctcgtggattttgtggcacatacccaggaagcgatcttccgtgatccgtggatggtttttgcgtggcgtccacgtccaggtgtttgggaatatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttctggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcgaagaacgttacacgtgggagcgctatgcggaacgcttgatgaccatcgcgcgtgttttcggcttttggcgcttcgttctggatcgcgaatcacaggtcatggaacgctatctgcaaatgttccgccacctgcaatggcgcccgctggctcatgccgtaccgatggag

SEQ ID NO: 2318 - protein, 793 aa, Artificial Sequence
  Variant of Sucrose Synthase
MIEELRQQLLDDPRSWDAFLRHLVASQRDSWLQTDLQRACADFREQLPEGYDEDIGPLVDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVLAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRGLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVEERYTWERYAERLMTIARVFGFWRFVLDRESQVMERYLQMFRHLQWRPLAHAVPME

SEQ ID NO: 2319 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccattgatcgaaagcctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2320 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPLIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2321 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2322 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2323 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattcttcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctatctggagccattgatcgaacgcctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2324 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPLIERLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2325 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaacgcctgctgtttggccgcgaaccaggtccggatatacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2326 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIERLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2327 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccagagatcgaacgcctgctgtttggccgcgaaccaggtccggatcagcgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2328 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPEIERLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2329 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttgggagtatgtgcgtattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaaagcctgctgtttggccgcgaaccaggtccggatcaacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2330 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIESLLFGREPGPDQRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2331 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2332 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2333 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaaagcctgctgtttggccgcgaaccaggtccggatatacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2334 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIESLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2335 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2336 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2337 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgcagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2338 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIESLLFGREPGPDQRGVLEDRQKPLILSMARMDRIKNLSGLAELYGRSSRLRSLANLVIIGGHVDVGNSMDAEERAEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2339 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaacgcctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2340 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2341 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccattgatcgaaagcctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2342 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPLIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2343 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2344 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2345 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggaatatgtgcatattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2346 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVHIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2347 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttgggagtatgtgcgtattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccattgatcgaacgcctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2348 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPLIERLLFGREPGPDQRGVLEDRQKPLLLSMARMDRIKNLSGLAELYGRSSRLRSLANLVIIGGHVDVGNSHDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2349 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcatattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagagatcgaacgcctgctgtttggccgcgaaccaggtccggatatacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2350 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVHIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIERLLFGREPGPDIRGVLEDRQKPLLLSMARMDRIKNLSGLAELYGRSSRLRSLANLVIIGGHVDVGNSHDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2351 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaaagcctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2352 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2353 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2354 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2355 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaacgcctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2356 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIERLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2357 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaacgcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2358 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2359 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccattgatcgaaagcctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2360 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2361 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2362 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2363 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagcctgctgtttggccgcgaaccaggtccggatcagcgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2364 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2365 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggaatatgtgcatattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2366 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVHIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2367 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2368 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2369 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttgggagtatgtgcgtattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2370 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2371 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgggatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacgacaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctatctggagccattgatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2372 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNDNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPLIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2373 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2374 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2375 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2376 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2377 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2378 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSHDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2379 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaacgcctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2380 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2381 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattcttcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2382 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2383 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagcaggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccagagatcgaaagcctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2384 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQQAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2385 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattcttcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaaagcctgctgtttggccgcgaaccaggtccggatcaacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2386 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIESLLFGREPGPDQRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2387 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctatctggagccagagatcgaaagcctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2388 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2389 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccattgatcgaacgcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2390 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPLIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2391 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctatctggagccagagatcgaaagcctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2392 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2393 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgcagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2394 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSHDAEERAEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2395 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccagagatcgaaagcctgctgtttggccgcgaaccaggtccggatcaacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2396 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2397 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgcagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2398 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLILSMARMDRIKNLSGLAELYGRSSRLRSLANLVIIGGHVDVGNSHDAEERAEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2399 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttggcattatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccagagatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgcagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2400 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWHYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPEIESLLFGREPGPDQRGVLEDRQKPLILSMARMDRIKNLSGLAELYGRSSRLRSLANLVIIGGHVDVGNSMDAEERAEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2401 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccagagatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2402 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPEIESLLFGREPGPDQRGVLEDRQKPLILSMARMDRIKNLSGLAELYGRSSRLRSLANLVIIGGHVDVGNSHDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2403 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2404 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2405 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccattgatcgaaagcctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2406 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPLIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2407 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcatgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2408 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLILSMARMDRIKNLSGLAELYGRSSRLRSLANLVIIGGHVDVGNSHDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2409 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2410 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2411 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2412 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2413 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagagatcgaacgcctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2414 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2415 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgtattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattcttcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaacgcctgctgtttggccgcgaaccaggtccggatatacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2416 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIERLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHNVPME

SEQ ID NO: 2417 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgcttctgtcgatggcccgtatggatcgcatcaagaacctgagcggtctggccgaactgtatggtcggagttctcgcttacgtagcctggccaatttggtgatcatcggtggtcatgttgatgtgggcaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2418 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLLLSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2419 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgcattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2420 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLHSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2421 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggaatatgtgcgtattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctatctggagccagagatcgaacgcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgtggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2422 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRYLEPEIERLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYVERLMTIARVFGFWRFVLSRESQVMERYLQMFRHLQWRPLAHAVPME

SEQ ID NO: 2423 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctctctggagccattgatcgaaagcctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgtgatgcagaagaacgcgcagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcataacgtaccgatggag

SEQ ID NO: 2424 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPLIESLLFGREPGPDQRGVLEDRQKPLILSMARMDRIKNLSGLAELYGRSSRLRSLANLVIIGGHVDVGNSRDAEERAEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHNVPME

SEQ ID NO: 2425 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccaggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcactgattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctgcccaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagcgggtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccacgctctctggagccagagatcgaacgcctgctgtttggccgcgaaccaggtccggatatacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaagactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2426 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFQDPWMVFAWRPRPGVWEYVRIHVEQLAVEELSTDEYLQAKEGLVGLGAEGEAVLTVDFTDFRPVSRRLRDESTIGDGLTHLNRHLAGRIWTDLAAGRSQILEFLSLHRLPNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAERVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPRSLEPEIERLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2427 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccaagctatctggagccagagatcgaacgcctgctgtttggccgcgaaccaggtccggatatacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgcggtaccgatggag

SEQ ID NO: 2428 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSYLEPEIERLLFGREPGPDIRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2429 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtcctctcgaagattttgtggcacatacccaggaagcgatcttccgtgatccgtggatggtttttgcgtggcgtccacgtccaggtgtttgggagtatgtgcgtattcatgtagaacagctggcggtggaggagctgagcactgatgaatatctgcaagccaaagaaggacttgttggcttaggtgccgaaggtgaagctgttctgacggtggatttcggagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggacaaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatatacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2430 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFGDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2431 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2432 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2433 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaacccttgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2434 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTLAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2435 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgcatgaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2436 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPHEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2437 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcacaaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2438 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHKDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2439 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcaaggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2440 - protein, 793 aa, Artificial Sequence
  Variant of Sucrose Synthase
MIEELRQQLLDDPRSWRAFLRHLVASQRDSWLQTDLQRACKDFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2441 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2442 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2443 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatggttagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2444 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMVSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2445 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcgggcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2446 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRGHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2447 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaacagcttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2448 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2449 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatatgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2450 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYMRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2451 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcacactgactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2452 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHTDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2453 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcgggggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2454 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRGGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2455 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcacgggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2456 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRTGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2457 - DNA, 2379 bp, Artificial Sequence
  Variant of Sucrose Synthase
atgattgaagaactgcgccaacagctgctggatgatccgcgttcatggcgtgcattcctgcgtcatttagtcacatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2458 - protein, 793 aa, Artificial Sequence
  Variant of Sucrose Synthase
MIEELRQQLLDDPRSWRAFLRHLVTSQRDSWLQTDLQRACADFREQLPEGYPEDIGPLEDFVAHTQEAIFRDPWMVFAWRPRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2459 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaagtgggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2460 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEVGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2461 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttcggtcacgcgaatcacaggtcatggaacgctatctgcaaatgttccgccacctgcaatggcgcccgctggctcatgccgtaccgatggag

SEQ ID NO: 2462 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVRSRESQVMERYLQMFRHLQWRPLAHAVPME

SEQ ID NO: 2463 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgggtgaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2464 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPGEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2465 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccggctgaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2466 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPAEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2467 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttccttctgtcacgcgaatcacaggtcatggaacgctatctgcaaatgttccgccacctgcaatggcgcccgctggctcatgccgtaccgatggag

SEQ ID NO: 2468 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFLLSRESQVMERYLQMFRHLQWRPLAHAVPME

SEQ ID NO: 2469 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccatggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2470 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2471 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaagctgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2472 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPEADGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2473 - DNA, 2379 bp, Artificial Sequence
  Variant of Sucrose Synthase
atgattgaagaactgcgccaacagctgctggatgatccgcgttcatggcgtgcattcctgcagcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2474 - protein, 793 aa, Artificial Sequence
  Variant of Sucrose Synthase
MIEELRQQLLDDPRSWRAFLQHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2475 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaaggcttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2476 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKERLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2477 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2478 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2479 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgcgcaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2480 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTAQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2481 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcacgtggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2482 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHVDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2483 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccgggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2484 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHRDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2485 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgcaggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2486 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPQEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2487 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggaggcgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgttagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2488 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEARILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2489 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaagcgcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2490 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2491 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaagtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2492 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2493 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatcttcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2494 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYLRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2495 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgctgtcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2496 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRCHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2497 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgtttgaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2498 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPFEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2499 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcacattgactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2500 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHIDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2501 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggtccgctcgaagattttgtggcacatacccaggaagcgatcttccgtgatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgccgaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgctgctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatggctagtggcctgccagtgtttgcgacccgcttcggtggtccgctggaaatcatcgaagacggcgttagcggcttccatattgatcccaacgaccctgaagcgaccgcagaacgtctggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2502 - protein, 793 aa, Artificial Sequence
  Variant of Sucrose Synthase
MIEELRQQLLDDPRSWRAFLRHLVASQRDSWLQTDLQRACADFREQLPEGYPEDIGPLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLLLSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMASGLPVFATRFGGPLEIIEDGVSGFHIDPNDPEATAERLADFLEAARERPHYWEEISDAALARVSERYTWERYAERLMTIARVFGFWRFVLSRESQVMERYLQMFRHLQWRPLAHAVPME

SEQ ID NO: 2503 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtgccttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgcaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2504 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERFSSLWPEIESLLFGREPGPDQRGVLEDRQKPLILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2505 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggatggcagattttgtggcacatacccaggaagcgatcttccgggatccgtggatggtttttgcgcaccgtccgcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccgtcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2506 - protein, 793 aa, Artificial Sequence
  Variant of Sucrose Synthase
MIEELRQQLLDDPRSWRAFLRHLVASQRDSWLQTDLQRACADFREQLPEGYPEDIGWMADFVAHTQEAIFRDPWMVFAHRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERPSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADRRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2507 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggatggcagattttgtggcacatacccaggaagcgatcttccgggatccgtggatggtttttgcgtggcgtggtcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaatattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataagcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2508 - protein, 793 aa, Artificial Sequence
  Variant of Sucrose Synthase
MIEELRQQLLDDPRSWRAFLRHLVASQRDSWLHTDLQRACADFREQLPEGYPEDIGWMADFVAHTQEAIFRDPWMVFAWRGRPGVWEYVRIHVEQLAVEELSTDEYLQAKEGLVGLGAEGEAVLTVDFEYFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADKRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2509 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2510 - protein, 793 aa, Artificial Sequence
  Variant of Sucrose Synthase
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2511 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtccgcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaatattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2512 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEYFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2513 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggatggcagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2514 - protein, 793 aa, Artificial Sequence
  Variant of Sucrose Synthase
MIEELRQQLLDDPRSWRAFLRHLVASQRDSWLHTDLQRACADFREQLPEGYPEDIGWMADFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2515 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctggcagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtgccttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgttcggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2516 - protein, 793 aa, Artificial Sequence
  Variant of Sucrose Synthase
MIEELRQQLLDDPRSWRAFLRHLVASQRDSWLQTDLQRACADFREQLPEGYPEDIGWLADFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2517 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctcgaagattttgtggcacatacccaggaagcgatcttccgggatccgtggatggtttttgcgcaccgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgcaaaatagtagggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2518 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAHRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDQRGVLEDRQKPLILSMARMDRIKNLSGLAELYGRSSRLRSLANLVIIGGHVDVQNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2519 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggatggaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtgccttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccgtcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggcgaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2520 - protein, 793 aa, Artificial Sequence
  Variant of Sucrose Synthase
MIEELRQQLLDDPRSWRAFLRHLVASQRDSWLHTDLQRACADFREQLPEGYPEDIGWMEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERPSSLWPEIESLLFGREPGPDIRGVLEDRQKPLILSMARMDRIKNLSGLAELYGRSSRLRSLANLVIIGGHVDVANSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2521 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtggtcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaatattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2522 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRGRPGVWEYVRIHVEQLAVEELSTDEYLQAKEGLVGLGAEGEAVLTVDFEYFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2523 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctcgaagattttgtggcacatacccaggaagcgatcttccgggatccgtggatggtttttgcgcaccgtggtcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgttcggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2524 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAHRGRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2525 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtggtcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgttcggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2526 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRGRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2527 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggcagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2528 - protein, 793 aa, Artificial Sequence
  Variant of Sucrose Synthase
MIEELRQQLLDDPRSWRAFLRHLVASQRDSWLHTDLQRACADFREQLPEGYPEDIGWLADFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2529 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtgccttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctgtggccagaaatcgaaagtctgctgtttggccgcgaaccaggtccggatcagcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2530 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLWPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2531 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgcaccgtatacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggagaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2532 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAHRIRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVENSMDAEEREEIRRMHEIMDHYQLDGQLRWVGSQLDKTVAGELYRVVADRRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2533 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctcgaagattttgtggcacatacccaggaagcgatcttccgggatccgtggatggtttttgcgcaccgtccgcgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtgccttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagcctggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgttcggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2534 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAHRPRPGVWEYVRIHVEQLAVEELSTDEYLQAKEGLVGLGAEGEAVLTVDFEDFRPVSRRLRDESTIGDGLTHLNRALAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2535 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgttcggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2536 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2537 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaatattttcgtccggtgagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgcaaaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatgggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2538 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEYFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVQNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2539 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcttccggaaggctatcccgaagatattggttggctggaagattttgtggcacatacccaggaagcgatcttccgggatccgtggatggtttttgcgtggcgtatacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtggggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2540 - protein, 793 aa, Artificial Sequence
  Variant of Sucrose Synthase
MIEELRQQLLDDPRSWRAFLRHLVASQRDSWLHTDLQRACADFREQLPEGYPEDIGWLEDFVAHTQEAIFRDPWMVFAWRIRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLWGREPGPDIRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADRRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2541 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2542 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPIILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2543 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcgcattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2544 - protein, 793 aa, Artificial Sequence
  Variant of Sucrose Synthase
MIEELRQQLLDDPRSWRAFLRHLVASQRDSWLQTDLQRACAHFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2545 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacattctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2546 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNILIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2547 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcatctctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2548 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVASLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2549 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatccgtcgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2550 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIRRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2551 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcgttcgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2552 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIVRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2553 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaagcggtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2554 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2555 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcgtcgtttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2556 - protein, 793 aa, Artificial Sequence
  Variant of Sucrose Synthase
MIEELRQQLLDDPRSWRAFLRHLVASQRDSWLQTDLQRACASFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2557 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatacgtcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2558 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYTSDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2559 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttccggttttggcgcttcgttctgtcacgcgaatcacaggtcatggaacgctatctgcaaatgttccgccacctgcaatggcgcccgctggctcatgccgtaccgatggag

SEQ ID NO: 2560 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFRFWRFVLSRESQVMERYLQMFRHLQWRPLAHAVPME

SEQ ID NO: 2561 - DNA, 2379 bp, Artificial Sequence
  Variant of Sucrose Synthase
atgattgaagaactgcgccaacagctgctggatgatccgcgttcatggcgtgcattcctgcgtcatttagtcgggtctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2562 - protein, 793 aa, Artificial Sequence
  Variant of Sucrose Synthase
MIEELRQQLLDDPRSWRAFLRHLVGSQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2563 - DNA, 2379 bp, Artificial Sequence
  Variant of Sucrose Synthase
atgattgaagaactgcgccaacagctgctggatgatccgcgttcatggcgtgcattcctgcgtcatttagtcgagtctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2564 - protein, 793 aa, Artificial Sequence
  Variant of Sucrose Synthase
MIEELRQQLLDDPRSWRAFLRHLVESQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2565 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcgacttttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2566 - protein, 793 aa, Artificial Sequence
  Variant of Sucrose Synthase
MIEELRQQLLDDPRSWRAFLRHLVASQRDSWLQTDLQRACATFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2567 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatctcgcgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2568 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAISRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2569 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattgctaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2570 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMIANVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2571 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttgggcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2572 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVWAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2573 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggactgtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2574 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWTVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2575 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggttctggcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2576 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVLAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2577 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatattccgggatccgtggtgggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2578 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWWVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2579 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatccatcgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2580 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIHRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2581 - DNA, 2379 bp, Artificial Sequence
  Variant of Sucrose Synthase
atgattgaagaactgcgccaacagctgctggatgatccgcgttcatggcgtgcattcctgcgtcatttagtcttgtctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2582 - protein, 793 aa, Artificial Sequence
  Variant of Sucrose Synthase
MIEELRQQLLDDPRSWRAFLRHLVLSQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2583 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccggtgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2584 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPVILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2585 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatggctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2586 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEWLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2587 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcaatcgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2588 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAINRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2589 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaactctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgtgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2590 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVVGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2591 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttccagttttggcgcttcgttctgtcacgcgaatcacaggtcatggaacgctatctgcaaatgttccgccacctgcaatggcgcccgctggctcatgccgtaccgatggag

SEQ ID NO: 2592 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFQFWRFVLSRESQVMERYLQMFRHLQWRPLAHAVPME

SEQ ID NO: 2593 - DNA, 2379 bp, Artificial Sequence
  Variant of Sucrose Synthase
atgattgaagaactgcgccaacagctgctggatgatccgcgttcatggcgtgcattcctgcgtcatttagtcgcatctcagcgtgactcatggttacagacggatttacagcgcgcgtgcgcggattttcgcgaacagcttccggaaggctatcccgaagatattggttggctcgaagattttgtggcacatacccaggaagcgatcttccgggatccgtggatggtttttgcgtggcgtccacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggttagccgtcgtttacgcgacgagagcaccattggtgatggtcttacccatctgaatcgtcatttagcaggtcgcatctggactgatttagcagcaggtcgtagtcagattctggaatttctgagcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattcagaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcccatcgtctctggagccagaaatcgaaagtctgctgtttggccgcgaaccaggtccggatcaacgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 2594 - protein, 793 aa, Artificial Sequence
  Variant of Sucrose Synthase
MIEELRQQLLDDPRSWRAFLRHLVASQRDSWLQTDLQRACADFREQLPEGYPEDIGWLEDFVAHTQEAIFRDPWMVFAWRPRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMIQNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERPSSLEPEIESLLFGREPGPDQRGVLEDRQKPLILSMARMDRIKNLSGLAELYGRSSRLRSLANLVIIGGHVDVGNSRDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 2595 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcagaaggcaatggaggtatcatgctgatgtgcacgagccgcaccattgaggctaagtacctggactattgtaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2596 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAEGNGGIMLMCTSRTIEAKYLDYCTELSNWKVVPVGPPFQDPITNDADDKELIDWLGTKDENSTVYVSFGSEYFLSREQMEEVAFGLELSNVNFIWVARFPKGEEQNLEDVLPKGFLERVGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2597 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcagaaggcaatatgggtatcatgctgatgtgcacgagccgcaccattgaggctaagtacctggactattgtaccgaactgagcaatgtaaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttagagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2598 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNMGIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQQRILNHPSTGGFISHCGWNSVMESIDFGVPIIAMPMQWDQPINAKLIVELGVAVEIVRDDDGNIHRGEIAETLRDVITGETGEILRGKVRDISKNLKSIREEEMNAAAEELIQLCRNSNKYK

SEQ ID NO: 2599 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2600 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2601 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatggaggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2602 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNGGIMLMCTSRTIEAKYLDYCTELSNWKVVPVGPPFQDPITNDADDKELIDWLGTKDENSTVYVSFGSEYFLSREQMEEVAFGLELSNVNFIWVARFPKGEEQNLEDVLPKGFLERVGERGRVLDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2603 - DNA, 1356 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaactttctgaagaacccgggtgtagaatttccgtttccggcgatcaacctgccgaaggtggaacaggtgaagatgcgcgagatgtttgaaaaggagccggatgaagaagatcgcttagcagaaggcaatggaggtatcatgctgatgtgcacgagccgcaccattgaggctaagtacctggactattgcaccgaactgagcaatgtaaaagttgttccggttggtccgccatttcaggacccgattactaatgatgcggacgacaaagaactgattgattggttagataccaaagacgagaacagtacagtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaagtaa

SEQ ID NO: 2604 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNGGIMLMCTSRTIEAKYLDYCTELSNVKVVPVGPPFQDPITNDADDKELIDWLDTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETIRDVMTGETGEILRGKVRDISKNLKSIREEEMNAAAEELIQLCRNSNKYK

SEQ ID NO: 2605 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggaaggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgtggtctatgtggcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2606 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVAFGSEYFLSREDMEEVAFGLELSNVNFIWVARFPKGEEQNLEDVLPKGFLERIGERGRVVDHFAPQPRILNHPSTGGFISHCGWNSVLESIDFGVPIIAMPMQWDQPINAKLIVELGVAVEIVRDDDGNIHRGEIAETIKDVMTGETGEILRGKVRDISKNLKSIREEEMNAAAEELIQLCRNSNKYK

SEQ ID NO: 2607 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcagaaggcaatggaggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2608 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNGGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2609 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagagggcaatatgggtatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2610 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERVGERGRVLDHFAPQQRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2611 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcagagggcaatatgggtatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttagataccaaagacgagaacagtacagtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2612 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSREIEAKYLDYCTELSNWKVVPVGPPFQDPITNDADDKELIDWLDTKDENSTVYVSFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2613 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2614 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSREIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2615 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagagggcaatatgggtatcatgctgatgtgcacgagccgcaccattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2616 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2617 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcacgattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2618 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2619 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcagaaggcaatggaggtatcatgctgatgtgcacgagccgcgaaattgaggctaagtacctggactattgtaccgaactgagcaattggaaagttgttccggttggtccgccatttcaggacccgattactaatgatgcggacgacaaagaactgattgattggttagataccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcattgggatcagccgattaacgcgaagctgatcgtggaattaggcgttgcagtggagatcgtgcgtgatgaagatggcaacattcaccgcggcgaaattgccgaaaccattagagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2620 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNGGIMLMCTSREIEAKYLDYCTELSNWKVVPVGPPFQDPITNDADDKELIDWLDTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMHWDQPINAKLIVELGVAVEIVRDEDGNIHRGEIAETIRDVITGETGEILRGKVRDISKNLKSIREEEMNAAAEELIQLCRNSNKYK

SEQ ID NO: 2621 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcagagggcaatatgggtatcatgctgatgtgcacgagccgcgaaattgaggctaagtacctggactatctgaccgaactgagcaattggaaagttgttccggttggtccgccatttcaggacccgattactaatgatgcggacgacaaagaactgattgattggttaggcaccaaagacgagaacagtgtggtctatgtgtcgtttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2622 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSREIEAKYLDYLTELSNWKVVPVGPPFQDPITNDADDKELIDWLGTKDENSVVYVSFGSEYFLSREQMEEVAFGLELSNVNFIWVARFPKGEEQNLEDVLPKGFLERIGERGRVLDHFAPQQRILNHPSTGGFISHCGWNSVLESIDFGVPIIAMPMQWDQPINAKLIVELGVAVEIVRDEDGNIHRGEIAETLKDVITGETGEILRGKVRDISKNLKSIREEEMNAAAEELIQLCRNSNKYK

SEQ ID NO: 2623 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactatctgaccgaactgagcaattggaaagttgttccggttggtccgccatttcaggacccgattactaatgatgcggacgacaaagaactgattgattggttaggcaccaaagacgagaacagtgtggtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2624 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSREIEAKYLDYLTELSNWKVVPVGPPFQDPITNDADDKELIDWLGTKDENSVVYVSFGSEYFLSREDMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2625 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggaaggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcacctggcaatatgggtatcatgctgatgtgcacgagccgcaccattgaggctaagtacctggactattgtaccgaactgagcaatgtaaaagttgttccggttggtccgccatttcaggacccgattactaatgatgcggacgacaaagaactgattgattggttaggcaccaaagacgagaacagtgtggtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2626 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAPGNMGIMLMCTSRTIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQWDQPINAKLIVELGVAVEIVRDDDGNIHRGEIAETIRDVMTGETGEILRGKVRDISKNLKSIREEEMNAAAEELIQLCRNSNKYK

SEQ ID NO: 2627 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcaccattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2628 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQWDQPINAKLIVELGVAVEIVRDEDGNIHRGEIAETLKDVITGETGEILRGKVRDISKNLKSIREEEMNAAAEELIQLCRNSNKYK

SEQ ID NO: 2629 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagaaggcaatatgggtatcatgctgatgtgcacgagccgcacgattgaggctaagtacctggactattgcaccgaactgagcaatgtaaaagttgttccggttggtccgccatttcaggacccgattactaatgatgcggacgacaaagaactgattgattggttagataccaaagacgagaacagtacagtctatgtgtcgtttggcagcgaatacttcctgagccgtgaacagatggaagaagtcgcgttcggcctggagctgagcaacgtgaactttatctgggttgcacgctttccaaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2630 - protein, 451 aa, Artificial Sequence
  "Variant of ADP-beta-1,2-glycosyltransferase"
MHHHHHHGGSGATLRVLMFPWLALGHINPFLSIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSRTIEAKYLDYCTELSNVKVVPVGPPFQDPITNDADDKELIDWLDTKDENSTVYVSFGSEYFLSREQMEEVAFGLELSNVNFIWVARFPKGEEQNLEDVLPKGFLERVGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2631 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgtcgaaggtggaacaggtgaagatgcgcgagatgtttgaaaaggagccggatgaagaagatcgcttagcagagggcaatatgggtatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggcaccaaagacgagaacagtgtggtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaacccttagagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2632 - protein, 451 aa, Artificial Sequence
  "Variant of ADP-beta-1,2-glycosyltransferase"
MHHHHHHGGSGATLRVLMFPWLALGHINPFLSIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAEGNMGIMLMCTSREIEAKYLDYCTELSNWKVVPVGPPFQDPITNDADDKELIDWLGTKDENSVVYVSFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQWDQPINAKLIVELGVAVEIVRDDDGNIHRGEIAETLRDVMTGETGEILRGKVRDISKNLKSIREEEMNAAAEELIQLCRNSNKYK

SEQ ID NO: 2633 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcagaaggcaatggaggtatcatgctgatgtgcacgagccgcacgattgaggctaagtacctggactattgcaccgaactgagcaattggaaagttgttccggttggtccgccatttcaggacccgattactaatgatgcggacgacaaagaactgattgattggttagataccaaagacgagaacagtacggtctatgtggcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2634 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAEGNGGIMLMCTSRTIEAKYLDYCTELSNWKVVPVGPPFQDPITNDADDKELIDWLDTKDENSTVYVAFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQWDQPINAKLIVELGVAVEIVRDDDGNIHRGEIAETIKDVMTGETGEILRGKVRDISKNLKSIREEEMNAAAEELIQLCRNSNKYK

SEQ ID NO: 2635 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcaccattgaggctaagtacctggactattgcaccgaactgagcaattggaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2636 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSRTIEAKYLDYCTELSNWKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2637 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcaccattgaggctaagtacctggactattgcaccgaactgagcaatgtaaaagttgttccggttggtccgccatttcaggacccgattactaatgatgcggacgacaaagaactgattgattggttaggcaccaaagacgagaacagtacagtctatgtgagctttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2638 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSRTIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2639 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatatgggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2640 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNMGIMLMCTSREIEAKYLDYCTELSNVKVVPVGPPFQDPITNDADDKELIDWLGTKDENSTVYVSFGSEYFLSREQMEEVAFGLELSNVNFIWVARFPKGEEQNLEDVLPKGFLERVGERGRVVDHFAPQPRILNHPSTGGFISHCGWNSVLESIDFGVPIIAMPMQWDQPINAKLIVELGVAVEIVRDEDGNIHRGEIAETLKDVITGETGEILRGKVRDISKNLKSIREEEMNAAAEELIQLCRNSNKYK

SEQ ID NO: 2641 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgtcgaaggtggaacaggtgaagatgcgcgagatgtttgaaaaggagccggatgaagaagatcgcttagcacctggcaatatgggtatcatgctgatgtgcacgagccgcgaaattgaggctaagtacctggactattgtaccgaactgagcaatgtaaaagttgttccggttggtccgccatttcaggacccgattactaatgatgcggacgacaaagaactgattgattggttagataccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2642 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLSKVEQVKMREMFEKEPDEEDRLAPGNMGIMLMCTSREIEAKYLDYCTELSNVKVVPVGPPFQDPITNDADDKELIDWLDTKDENSTVYVSFGSEYFLSREDMEEVAFGLELSNVNFIWVARFPKGEEQNLEDVLPKGFLERVGERGRVLDHFAPQPRILNHPSTGGFISHCGWNSVLESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2643 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaatccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcaccattgaggctaagtacctggactatctgaccgaactgagcaattggaaagttgttccggttggtccgccatttcaggacccgattactaatgatgcggacgacaaagaactgattgattggttaggtaccaaagacgagaacagtacggtctatgtgagctttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagccgcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgccgaaaccattaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2644 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAPGNGGIMLMCTSRTIEAKYLDYLTELSNWKVVPVGPPFQDPITNDADDKELIDWLGTKDENSTVYVSFGSEYFLSREQMEEVAFGLELSNVNFIWVARFPKGEEQNLEDVLPKGFLERIGERGRVLDHFAPQPRILNHPSTGGFISHCGWNSVLESIDFGVPIIAMPMQWDQPINAKLIVELGVAVEIVRDEDGNIHRGEIAETIKDVMTGETGEILRGKVRDISKNLKSIREEEMNAAAEELIQLCRNSNKYK

SEQ ID NO: 2645 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgagcatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagaacccgggtgtagaatttccgtttccggcgatcaacctgccgaaggtggaacaggtgaagatgcgcgagatgtttgaaaaggagccggatgaagaagatcgcttagcagaaggcaatggaggtatcatgctgatgtgcacgagccgcaccattgaggctaagtacctggactattgcaccgaactgagcaatgtaaaagttgttccggttggtccgccatttcaggacccgattactaatgatgcggacgacaaagaactgattgattggttaggcaccaaagacgagaacagtgtggtctatgtggcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggaccattttgcaccgcagcagcgtattctgaaccatccgagcacgggtggcttcatctctcattgcggttggaacagcgtcctggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2646 - protein, 451 aa, Artificial Sequence
  "Variant of ADP-beta-1,2-glycosyltransferase"
MHHHHHHGGSGATLRVLMFPWLALGHINPFLSIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKNPGVEFPFPAINLPKVEQVKMREMFEKEPDEEDRLAEGNGGIMLMCTSRTIEAKYLDYCTELSNVKVVPVGPPFQDPITNDADDKELIDWLGTKDENSVVYVAFGSEYFLSREDMEEVAFGLELSNVNFIWVARFPKGEEQNLEDVLPKGFLERIGERGRVLDHFAPQQRILNHPSTGGFISHCGWNSVLESIDFGVPIIAMPMQWDQPINAKLIVELGVAVEIVRDDDGNIHRGEIAETIKDVMTGETGEILRGKVRDISKNLKSIREEEMNAAAEELIQLCRNSNKYK

SEQ ID NO: 2647 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgaaaaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2648 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLKNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2649 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgagtaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2650 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLSNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2651 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgaaaaatccgggtgtagaatttccgtttccggcgatcaacctgtcgaaggtggaacaggtgaagatgcgcgagatgtttgaaaaggagccggatgaagaagatcgcttagcagaacatgctatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2652 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLKNPGVEFPFPAINLSKVEQVKMREMFEKEPDEEDRLAEHAMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2653 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgagtgggccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2654 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLSGPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2655 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaagcgtgggcagaacatgtcgtaaacgaacagaacatcccggctgttaagattctgaccagtggtgcggcactgtttagctaccgattcaacttcctgaaagggccgggtgtagaatttccgtttccggcgatcaacctgtcgaaggtggaacaggtgaagatgcgcgagatgtttgaaaaggagccggatgaagaagatcgcttagcagaaggggctatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2656 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQAWAEHVVNEQNIPAVKILTSGAALFSYRFNFLKGPGVEFPFPAINLSKVEQVKMREMFEKEPDEEDRLAEGAMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2657 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgagtactccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2658 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLSTPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2659 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcttcaagcgtgggcagaacatgtcgtaaacgaacagaacatcccggctgttaagattctgaccagtggtgcggcactgtttagctactttttcaacttcctgagtgggccgggtgtagaatttccgtttccggcgatcaacctgtcgaaggtggaacaggtgaagatgcgcgagatgtttgaaaaggagccggatgaagaagatcgcttagcagaaggggctatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2660 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQAWAEHVVNEQNIPAVKILTSGAALFSYFFNFLSGPGVEFPFPAINLSKVEQVKMREMFEKEPDEEDRLAEGAMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2661 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcttcaagcgtgggcagaacatgtcgtaaacgaacagaacatcccggctgttaagattctgaccagtggtgcggcactgtttagctaccgattcaacttcctgaaagggccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2662 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQAWAEHVVNEQNIPAVKILTSGAALFSYRFNFLKGPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2663 - DNA, 1353 bp, Artificial Sequence; identical to SEQ ID NO: 2653
  "Variant of ADP-beta-1,2-glycosyltransferase"

SEQ ID NO: 2664 - protein, 451 aa, Artificial Sequence; identical to SEQ ID NO: 2654
  "Variant of ADP-beta-1,2-glycosyltransferase"

SEQ ID NO: 2665 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgaaagggccgggtgtagaatttccgtttccggcgatcaacctgtcgaaggtggaacaggtgaagatgcgcgagatgtttgaaaaggagccggatgaagaagatcgcttagcagaacataacatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2666 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFLQPWAEHVVNEQNIPAVKILTSGAALFSYRFNFLKGPGVEFPFPAINLSKVEQVKMREMFEKEPDEEDRLAEHNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2667 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtatcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcatcaagcgtgggcagaacatgtcgtaaacgaacagaacatcccggctgttaagattctgaccagtggtgcggcactgtttagctactttttcaacttcctgagtgggccgggtgtagaatttccgtttccggcgatcaacctgtcgaaggtggaacaggtgaagatgcgcgagatgtttgaaaaggagccggatgaagaagatcgcttagcagaagggaacatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2668 - protein, 451 aa, Artificial Sequence
  "Variant of ADP-beta-1,2-glycosyltransferase"
MHHHHHHGGSGATLRVLMFPYLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFHQAWAEHVVNEQNIPAVKILTSGAALFSYFFNFLSGPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2669 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcagcaagcgtgggcagaacatgtcgtaaacgaacagaacatcccggctgttaagattctgaccagtggtgcggcactgtttagctactttttcaacttcctgagtaatccgggtgtagaatttccgtttccggcgatcaacctgtcgaaggtggaacaggtgaagatgcgcgagatgtttgaaaaggagccggatgaagaagatcgcttagcagaacatgctatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2670 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFQQAWAEHVVNEQNIPAVKILTSGAALFSYFFNFLSNPGVEFPFPAINLSKVEQVKMREMFEKEPDEEDRLAEHAMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2671 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcatcaagcgtgggcagaacatgtcgtaaacgaacagaacatcccggctgttaagattctgaccagtggtgcggcactgtttagctactttttcaacttcctgaaaactccgggtgtagaatttccgtttccggcgatcaacctgtcgaaggtggaacaggtgaagatgcgcgagatgtttgaaaaggagccggatgaagaagatcgcttagcagaagggaacatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagcctattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2672 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFHQAWAEHVVNEQNIPAVKILTSGAALFSYFFNFLKTPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2673 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcttcaaccgtgggcagaacatgtcgtaaacgaacagaacatcccggctgttaagattctgaccagtggtgcggcactgtttagctaccgattcaacttcctgagtgggccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2674 - protein, 451 aa, Artificial Sequence; identical to SEQ ID NO: 2654
  "Variant of ADP-beta-1,2-glycosyltransferase"

SEQ ID NO: 2675 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcagcaagcgtgggcagaacatgtcgtaaacgaacagaacatcccggctgttaagattctgaccagtggtgcggcactgtttagctactttttcaacttcctgagtgggccgggtgtagaatttccgtttccggcgatcaacctgtcgaaggtggaacaggtgaagatgcgcgagatgtttgaaaaggagccggatgaagaagatcgcttagcagaacataacatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2676 - protein, 451 aa, Artificial Sequence
  "Variant of ADP-beta-1,2-glycosyltransferase"
MHHHHHHGGSGATLRVLMFPWLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFQQAWAEHVVNEQNIPAVKILTSGAALFSYFFNFLSGPGVEFPFPAINLSKVEQVKMREMFEKEPDEEDRLAEHNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2677 - DNA, 1353 bp, Artificial Sequence; identical to SEQ ID NO: 2653
  "Variant of ADP-beta-1,2-glycosyltransferase"

SEQ ID NO: 2678 - protein, 451 aa, Artificial Sequence; identical to SEQ ID NO: 2654
  "Variant of ADP-beta-1,2-glycosyltransferase"

SEQ ID NO: 2679 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtatcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcatcaagcgtgggcagaacatgtcgtaaacgaacagaacatcccggctgttaagattctgaccagtggtgcggcactgtttagctactttttcaacttcctgaaaactccgggtgtagaatttccgtttccggcgatcaacctgtcgaaggtggaacaggtgaagatgcgcgagatgtttgaaaaggagccggatgaagaagatcgcttagcagaacatgctatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2680 - protein, 451 aa, Artificial Sequence
  "Variant of ADP-beta-1,2-glycosyltransferase"
MHHHHHHGGSGATLRVLMFPYLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFHQAWAEHVVNEQNIPAVKILTSGAALFSYFFNFLKTPGVEFPFPAINLSKVEQVKMREMFEKEPDEEDRLAEHAMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2681 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaagattctgaccagtggtgcggcactgtttagctaccgattcaacttcctgagtactccgggtgtagaatttccgtttccggcgatcaacctgtcgaaggtggaacaggtgaagatgcgcgagatgtttgaaaaggagccggatgaagaagatcgcttagcagaagggaacatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2682 - protein, 451 aa, Artificial Sequence; identical to SEQ ID NO: 2658
  "Variant of ADP-beta-1,2-glycosyltransferase"

SEQ ID NO: 2683 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtatcttgcggagggtcatattaacccgtttttgaatatcgctaaacaactggccgatcgtggtttcctgatctatttatgcagtaccctgattaacctcgaaagcattatcaagaagatcccggagaaatacagtgagagcatccatctggtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgattttcatcaagcgtgggcagaacatgtcgtaaacgaacagaacatcccggctgttaagattctgaccagtggtgcggcactgtttagctactttttcaacttcctgagtaatccgggtgtagaatttccgtttccggcgatcaacctgtcgaaggtggaacaggtgaagatgcgcgagatgtttgaaaaggagccggatgaagaagatcgcttagcagaaggcaatatgcagatcatgctgatgtgcacgagccgcgaaattgaggctaagtacctggactattgcaccgaactgagcaattggaaagttgttccggttggtccgccatttcaggacccgattactaatgatgcggacgacaaagaactgattgattggttaggtaccaaagacgagaacagtacggtctatgtggcgtttggcagcgaatacttcctgagccgtgaagatatggaagaactggcgttcggcctggagctgagcaacgtgaactttatctgggttgcacgctttccgaaaggcgaggaacagaatctggaagacgttctgccaaaaggcttcctggaacgcgttggtgaacgtggtcgcgttgtggaccattttgcaccgcagccgcgtattctgaaccatccgagcacgggtggcttcatctctcattgcggttggaacagcgtcctggaaagcattgattttggcgttccgatcattgcgatgccgatgcagaacgatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2684 - protein, 451 aa, Artificial Sequence
  "Variant of ADP-beta-1,2-glycosyltransferase"
MHHHHHHGGSGATLRVLMFPYLAEGHINPFLNIAKQLADRGFLIYLCSTLINLESIIKKIPEKYSESIHLVELHLPELPELPPHYHTTNGLPPHLNHTLHKALKMSKPNFSKILQNLKPDLVIYDFHQAWAEHVVNEQNIPAVKILTSGAALFSYFFNFLSNPGVEFPFPAINLSKVEQVKMREMFEKEPDEEDRLAEGNMQIMLMCTSREIEAKYLDYCTELSNWKVVPVGPPFQDPITNDADDKELIDWLGTKDENSTVYVAFGSEYFLSREDMEELAFGLELSNVNFIWVARFPKGEEQNLEDVLPKGFLERVGERGRVVDHFAPQPRILNHPSTGGFISHCGWNSVLESIDFGVPIIAMPMQNDQPINAKLIVELGVAVEIVRDDDGNIHRGEIAETLKDVITGETGEILRGKVRDISKNLKSIREEEMNAAAEELIQLCRNSNKYK

SEQ ID NO: 2685 - DNA, 1353 bp, Artificial Sequence
  "Variant of ADP-beta-1,2-glycosyltransferase"
atgcaccatcatcatcatcatggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgtggcggcggaagaactgatccagctgtgtcgcaacagcaacaagtacaag

SEQ ID NO: 2686 - protein, 451 aa, Artificial Sequence
  "Variant of ADP-beta-1,2-glycosyltransferase"
MHHHHHHGGSGSTLKVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETIKDVITGETGEILRGKVRDISKNLKSIREEEMNVAAEELIQLCRNSNKYK

SEQ ID NO: 2687 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaaagcgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2688 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKSVITGETGEILRGKVRDISKNLKSIREEEMNAAAEELIQLCRNSNKYK

SEQ ID NO: 2689 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaaa

SEQ ID NO: 2690 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETIKDVITGETGEILRGKVRDISKNLKSIREEEMNAAAEELIQLCRNSNKYK

SEQ ID NO: 2691 - DNA, 1353 bp, Artificial Sequence
  "Variant of ADP-beta-1,2-glycosyltransferase"
atgcaccatcatcatcatcatggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgatgaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaaa

SEQ ID NO: 2692 - protein, 451 aa, Artificial Sequence
  "Variant of ADP-beta-1,2-glycosyltransferase"
MHHHHHHGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKDVMTGETGEILRGKVRDISKNLKSIREEEMNAAAEELIQLCRNSNKYK

SEQ ID NO: 2693 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcacaaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaag

SEQ ID NO: 2694 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2695 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccagagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactatctaaccgaactgagcaatgtaaaagttgttccggttggtccgccatttcaggacccgattactaatgatgcggacgacaaagaactgattgattggttaggcaccaaagacgagaacagtgttgtctatgtggcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2696 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYLTELSNVKVVPVGPPFQDPITNDADDKELIDWLGTKDENSVVYVAFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETIKDVITGETGEILRGKVRDISKNLKSIREEEMNAAAEELIQLCRNSNKYK

SEQ ID NO: 2697 - DNA, 1353 bp, Artificial Sequence
  "Variant of ADP-beta-1,2-glycosyltransferase"
atgcaccatcatcatcatcatggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaac

SEQ ID NO: 2698 - protein, 451 aa, Artificial Sequence
  "Variant of ADP-beta-1,2-glycosyltransferase"
MHHHHHHGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYN

SEQ ID NO: 2699 - DNA, 1353 bp, Artificial Sequence
  "Variant of ADP-beta-1,2-glycosyltransferase"
atgcaccatcatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgtggcggcggaagaactgatccagctgtgtcgcaacagcaacaagtacaaa

SEQ ID NO: 2700 - protein, 451 aa, Artificial Sequence
  "Variant of ADP-beta-1,2-glycosyltransferase"
MHHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNVAAEELIQLCRNSNKYK

SEQ ID NO: 2701 - DNA, 1353 bp, Artificial Sequence
  "Variant of ADP-beta-1,2-glycosyltransferase"
atgcaccatcatcatcatcatggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcataaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtactgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaaagcgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaac

SEQ ID NO: 2702 - protein, 451 aa, Artificial Sequence
  "Variant of ADP-beta-1,2-glycosyltransferase"
MHHHHHHGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETIKSVITGETGEILRGKVRDISKNLKSIREEEMNAAAEELIQLCRNSNKYN

SEQ ID NO: 2703 - DNA, 1353 bp, Artificial Sequence
  "Variant of ADP-beta-1,2-glycosyltransferase"
atgcaccatcatcatcatcatggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctgattgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2704 - protein, 451 aa, Artificial Sequence
  "Variant of ADP-beta-1,2-glycosyltransferase"
MHHHHHHGGSGSTLKVLMFPWLALGHINPFLNIAKQLADRGFLIYLCSTLINLESIKKKIPEKYSESIHLIELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2705 - DNA, 1353 bp, Artificial Sequence
  "Variant of ADP-beta-1,2-glycosyltransferase"
atgcaccatcatcatcatcatggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcacaaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaaagcgtgatgaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaac

SEQ ID NO: 2706 - protein, 451 aa, Artificial Sequence
  "Variant of ADP-beta-1,2-glycosyltransferase"
MHHHHHHGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETIKSVMTGETGEILRGKVRDISKNLKSIREEEMNAAAEELIQLCRNSNKYN

SEQ ID NO: 2707 - DNA, 1353 bp, Artificial Sequence
  "Variant of ADP-beta-1,2-glycosyltransferase"
atgcaccatcatcatcatcatggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtggcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2708 - protein, 451 aa, Artificial Sequence
  "Variant of ADP-beta-1,2-glycosyltransferase"
MHHHHHHGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVAFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2709 - DNA, 1353 bp, Artificial Sequence
  "Variant of ADP-beta-1,2-glycosyltransferase"
atgcaccatcatcatcatcatggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcacaaaagacgagaacagtacggtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgatgaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaaa

SEQ ID NO: 2710 - protein, 451 aa, Artificial Sequence
  "Variant of ADP-beta-1,2-glycosyltransferase"
MHHHHHHGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAQTIKDVMTGETGEILRGKVRDISKNLKSIREEEMNAAAEELIQLCRNSNKYK

SEQ ID NO: 2711 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2712 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2713 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttaaaggcgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2714 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKGVITGETGEILRGKVRDISKNLKSIREEEMNAAAEELIQLCRNSNKYK

SEQ ID NO: 2715 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaaa

SEQ ID NO: 2716 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2717 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2718 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2719 - DNA, 1353 bp, Artificial Sequence
  "Variant of ADP-beta-1,2-glycosyltransferase"
atgcaccatcatcatcatcatggcggtagcggcgcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtactgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaag

SEQ ID NO: 2720 - protein, 451 aa, Artificial Sequence
  "Variant of ADP-beta-1,2-glycosyltransferase"
MHHHHHHGGSGATLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2721 - DNA, 1353 bp, Artificial Sequence
  "Variant of ADP-beta-1,2-glycosyltransferase"
atgcaccatcatcatcatcatggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactatctaaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgatgaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaag

SEQ ID NO: 2722 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYLTELSNVKVVPVGPPFQDPITNDADDKELIDWLGTKDENSVVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAQTIKDVMTGETGEILRGKVRDISKNLKSIREEEMNAAAEELIQLCRNSNKYK

SEQ ID NO: 2723 - DNA, 1353 bp, Artificial Sequence
  "Variant of ADP-beta-1,2-glycosyltransferase"
atgcaccatcatcatcatcatggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactatctaaccgaactgagcaatgtaaaagttgttccggttggtccgccatttcaggacccgattactaatgatgcggacgacaaagaactgattgattggttaggcaaaaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcggcggcggaagaactgatccagctgtgtcgcaacagcaacaagtacaag

SEQ ID NO: 2724 - protein, 451 aa, Artificial Sequence
  "Variant of ADP-beta-1,2-glycosyltransferase"
MHHHHHHGGSGSTLKVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYLTELSNVKVVPVGPPFQDPITNDADDKELIDWLGKKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETIKDVITGETGEILRGKVRDISKNLKSIREEEMNAAAEELIQLCRNSNKYK

SEQ ID NO: 2725 - DNA, 1353 bp, Artificial Sequence
  "Variant of ADP-beta-1,2-glycosyltransferase"
atgcaccatcatcatcatgaaggcggtagcggcgcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcacaaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgtgctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaac

SEQ ID NO: 2726 - protein, 451 aa, Artificial Sequence
  "Variant of ADP-beta-1,2-glycosyltransferase"
MHHHHHEGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYN

SEQ ID NO: 2727 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcgtgaagcgaccgggtgtagaatttccgtttccggcgatcaacctgccgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2728 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFVKRPGVEFPFPAINLPKVEQVKMREMMEKEPDEEDPLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2729 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaactttctgaagcgaccgggtgtagaatttccgtttccggcgatcaacctgccgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2730 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDPLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2731 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcagtgtttagctactttttcaacttcctgaagcgaccgggtgtagaatttccgtttccggcgatcaacctgccgaaggtggaacaggtgaagatgcgcgagatgtttgaaaaggagccggatgatgaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2732 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAAVFSYFFNFLKRPGVEFPFPAINLPKVEQVKMREMFEKEPDDEDPLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2733 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattgctaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2734 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPIANDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2735 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgtttactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2736 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPFTNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2737 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgtcgattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2738 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPSILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2739 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccgcgggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2740 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTAGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2741 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattcctaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggtgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2742 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPIPNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2743 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccggagactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2744 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPETNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2745 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgttccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2746 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFVPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2747 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttcttgaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2748 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVLDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2749 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgcaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgctatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2750 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVANEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2751 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccatatggcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2752 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHMAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2753 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcagtttttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2754 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAAVFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2755 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgatggtggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2756 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDGGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2757 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatggtggaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2758 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMVEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2759 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgcggatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2760 - protein, 451 aa, Artificial Sequence
  "Variant of ADP-beta-1,2-glycosyltransferase"
MHHHHHHGGSGATLRVLMFPWLALGHINPFLRIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2761 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcagactccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2762 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQTPITNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2763 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccgttttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2764 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDRFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2765 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2766 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPHILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2767 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcaggcgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2768 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQARILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2769 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggacgggtttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2770 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDGFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2771 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgtatactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2772 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPYTNDADDKELIDWLGTKDENSTVYVSFGSEYFLSREDMEEVAFGLELSNVNFIWVARFPKGEEQNLEDVLPKGFLERIGERGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2773 - DNA, 1353 bp, Artificial Sequence
  "Variant of ADP-beta-1,2-glycosyltransferase"
atgcaccatcatcatcatcatggcggtagcggcgctaccctgcgcgtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggtggagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgccgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtacggtctatgtgagctttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttgtggaccattttgcaccgcagccgtgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2774 - protein, 451 aa, Artificial Sequence
  "Variant of ADP-beta-1,2-glycosyltransferase"
MHHHHHHGGSGATLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLPKVEQVKMREMFEKEPDEEDRLAPGNGGIMLMCTSREIEAKYLDYCTELSNVKVVPVGPPFQDPITNDADDKELIDWLGTKDENSTVYVSFGSEYFLSREDMEEVAFGLELSNVNFIWVARFPKGEEQNLEDVLPKGFLERIGERGRVVDHFAPQPCILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2775 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcagacgccgattgccaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatatggtgccgcagccccgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2776 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMMEKEPDEEDPLAPGNGGIMLMCTSREIEAKYLDYCTELSNVKVVPVGPPFQTPIANDADDKELIDWLGTKDENSVVYVSFGSEYFLSREDMEEVAFGLELSNVNFIWVARFPKGEEQNLEDVLPKGFLERIGDRGRVVDHMVPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2777 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggccatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2778 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDEDGNIHRGEIAQTIKDVITGETGEILRGKVRDISKNLKSIREEEMNAAAEELIQLCRNSNKYK

SEQ ID NO: 2779 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2780 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2781 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcataaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggccatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatatcaggacccgattaccaatgatgcggacgacaaagaactgattgattggttaggtaccaaagacgagaacagtgttgtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatatggtgccgcaggcccgtattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2782 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPYQDPITNDADDKELIDWLGTKDENSVVYVSFGSEYFLSREDMEEVAFGLELSNVNFIWVARFPKGEEQNLEDVLPKGFLERIGDRGRVVDHMVPQARILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2783 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatttcgtgccgcagccccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2784 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFVPQPHILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2785 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaggatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaacctcgggtgcggcactgtttagctactttttcaacttcctgaagcgaccgggtgtagaatttccgtttccggcgatcaacctgtcgaaggtggaacaggtgaagatgcgcgaggccttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggtaccaaagacgagaacagtgttgtctatgtgtcgtttggcagcgaatacttcctgagccgtgaacaaatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttctggaccatttcgtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2786 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAFEKEPDEEDRLAPGNGGIMLMCTSREIEAKYLDYCTELSNVKVVPVGPPFQDPITNDADDKELIDWLGTKDENSVVYVSFGSEYFLSREQMEEVAFGLELSNVNFIWVARFPKGEEQNLEDVLPKGFLERIGDRGRVLDHFVPQAHILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2787 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgatggtggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2788 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDGGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2789 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaacctcgggtgcggcactgtttagctactttttcaacttcctgaagcgaccgggtgtagaatttccgtttccggcgatcaacctgtcgaaggtggaacaggtgaagatgcgcgaggccatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatggccaatgatgcggacgacaaagaactgattgattggttaggtaccaaagacgagaacagtgttgtctatgtgtcgtttggcagcgaatacttcctgagccgtgaacaaatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatttcgcgccgcaggcccgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2790 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPFQDPMANDADDKELIDWLGTKDENSVVYVSFGSEYFLSREQMEEVAFGLELSNVNFIWVARFPKGEEQNLEDVLPKGFLERIGDRGRVVDHFAPQARILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2791 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcagacgccgatggccaatgatgcggacgacaaagaactgattgattggttaggtaccaaagacgagaacagtgttgtctatgtgtcgtttggcagcgaatacttcctgagccgtgaacaaatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttctggaccatttcgtgccgcagcaacgtattctgaaccatccgagcacgggtggcttcatctctcattgcggttggaacagcgtcatggaaagcattgatggtggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2792 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMMEKEPDEEDRLAPGNGGIMLMCTSREIEAKYLDYCTELSNVKVVPVGPPFQTPMANDADDKELIDWLGTKDENSVVYVSFGSEYFLSREQMEEVAFGLELSNVNFIWVARFPKGEEQNLEDVLPKGFLERIGDRGRVLDHFVPQQRILNHPSTGGFISHCGWNSVMESIDGGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2793 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggcaccaaagacgagaacagtgttgtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2794 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMMEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2795 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgcagggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggtaccaaagacgagaacagtgttgtctatgtgtcgtttggcagcgaatacttcctgagccgtgaacaaatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatttcgtgccgcaggcccgtattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2796 - protein, 450 aa, Artificial Sequence
  "Variant of ADP-beta-1,2-glycosyltransferase"
MHHHHEGGSGSTLRVLMFPWLAQGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREQMEEVAFGLELSNVNFIWVARFPKGEEQNLEDVLPKGFLERIGDRGRVVDHFVPQARILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2797 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaggatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatttcgcgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2798 - protein, 450 aa, Artificial Sequence
  "Variant of ADP-beta-1,2-glycosyltransferase"
MHHHHEGGSGSTLKVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERVGDRGRVVDHFAPQAHILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2799 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggccttcgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatatcaggacccgattactaatgatgcggacgacaaagaactgattgattggttaggcaccaaagacgagaacagtgttgtctatgtgtcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatttcgtgccgcagcaacgtattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2800 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAFEKEPDEEDPLAPGNGGIMLMCTSREIEAKYLDYCTELSNVKVVPVGPPYQDPITNDADDKELIDWLGTKDENSVVYVSFGSEYFLSREDMEEVAFGLELSNVNFIWVARFPKGEEQNLEDVLPKGFLERVGDRGRVVDHFVPQQRILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2801 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttctggaccatttcgtgccgcagccccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2802 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVLDHFVPQPHILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2803 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcataaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccgcgggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcagacgccgatgaccaatgatgcgggcgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccattttgcaccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2804 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTAGAALFSYFFNFLKRPGVEFPFPAINLSKVEQVKMREMFEKEPDEEDRLAPGNGGIMLMCTSREIEAKYLDYCTELSNVKVVPVGPPFQTPMTNDAGDKELIDWLGTKDENSVVYVSFGSEYFLSREDMEEVAFGLELSNVNFIWVARFPKGEEQNLEDVLPKGFLERVGDRGRVVDHFAPQAHILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2805 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggccttcgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgatggtggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2806 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAFEKEPDEEDPLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDGGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2807 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgttcgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttagataccaaagacgagaacagtgttgtctatgtgtcgtttggcagcgaatacttcctgagccgtgaacaaatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatttcgtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgaagctgatcgtggaattaggcgttgcagtggagatcgtgcgtgatgatgatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2808 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLDTKDENSVVYVSFGSEYFLSREQMEEVAFGLELSNVNFIWVARFPKGEEQNLEDVLPKGFLERVGDRGRVVDHFVPQAHILNHPSTGGFISHCGWNSVMESIDFGVPIIAMPMQWDQPINAKLIVELGVAVEIVRDDDGNIHRGEIAETIKDVITGETGEILRGKVRDISKNLKSIREEEMNAAAEELIQLCRNSNKYK

SEQ ID NO: 2809 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgcagggtcatattaacccgtttttgaggatcgctaaacaactggccgatcgtggtttcctgatctatttatgcagtaccctgattaacctcgaaagcatcataaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccgcgggtgcggcactgtttagctactttttcaacttcctgaagcgaccgggtgtagaatttccgtttccggcgatcaacctgtcgaaggtggaacaggtgaagatgcgcgaggccatggaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttagataccaaagacgagaacagtgttgtctatgtatcgtttggcagcgaatacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccatatggcgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgccgaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2810 - protein, 450 aa, Artificial Sequence
  "Variant of ADP-beta-1,2-glycosyltransferase"
MHHHHEGGSGSTLKVLMFPWLAQGHINPFLRIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTAGAALFSYFFNFLKRPGVEFPFPAINLSKVEQVKMREAMEKEPDEEDRLAPGNGGIMLMCTSREIEAKYLDYCTELSNVKVVPVGPPFQDPMTNDADDKELIDWLDTKDENSVVYVSFGSEYFLSREDMEEVAFGLELSNVNFIWVARFPKGEEQNLEDVLPKGFLERIGDRGRVVDHMAPQAHILNHPSTGGFISHCGWNSVMESIDFGVPIIAMPMQWDQPINAKLIVELGVAVEIVRDEDGNIHRGEIAETIKDVITGETGEILRGKVRDISKNLKSIREEEMNAAAEELIQLCRNSNKYK

SEQ ID NO: 2811 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgatggtggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2812 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDGGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2813 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2814 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2815 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgatgactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2816 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2817 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgatagcatccatctggttgagctgcatctgccagaattgccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgaccactagcgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2818 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSDSIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPTTSDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2819 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgtgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaagaagaaatgaatgcagcggcggaagaactgatccagctgtgtcgcaacagcaacaagtacaag

SEQ ID NO: 2820 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSDSIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2821 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgatagcatccatctggttgagctgcatctgccagaattgccggaactgccaccacattaccatactaccaacggtttaccaccgcatctgaacgggaccctgcacaaggcactgaagatgagcaagccgaactttagcaagatcctggaaaacctgaagccggacctggtcatctacgattttctgcaaccgtgggcagaacgtgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgatgactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaagaagaaatgaatgcagcggcggaagaactgatccagctgtgtcgcaacagcaacaagtacaag

SEQ ID NO: 2822 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSDSIHLVELHLPELPELPPHYHTTNGLPPHLNGTLHKALKMSKPNFSKILENLKPDLVIYDFLQPWAERVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2823 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattgccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgaccaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagagcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2824 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELTNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGESLRGKVRDISKNLKSIREEEMNAAAEELIQLCRNSNKYK

SEQ ID NO: 2825 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggccgtattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2826 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGRIHRGEIAETLKDVITGETGEILRGKVRDISKNLKSIREEEMNAAAEELIQLCRNSNKYK

SEQ ID NO: 2827 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccagagggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2828 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPEGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2829 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2830 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSNSIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2831 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagcttagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2832 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKLSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2833 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagccggaacctgaagagcattcgcgaggaagaaatgaatgcagcggcggaagaactgatccagctgtgtcgcaacagcaacaagtacaag

SEQ ID NO: 2834 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISRNLKSIREEEMNAAAEELIQLCRNSNKYK

SEQ ID NO: 2835 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcactaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2836 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESITKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2837 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagcgtatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2838 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKRIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2839 - DNA, 1350 bp, Artificial Sequence
  "Variant of ADP-beta-1,2-glycosyltransferase"
atgcaccatcatcatgaaggcggtagcggcggtaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2840 - protein, 450 aa, Artificial Sequence
  "Variant of ADP-beta-1,2-glycosyltransferase"
MHHHHEGGSGGTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2841 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatgtgtgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2842 - protein, 450 aa, Artificial Sequence
  "Variant of ADP-beta-1,2-glycosyltransferase"
MHHHHEGGSGSTLKVLMFPWLALGHINPFLNIAKQLADRGFLIYVCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2843 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagggtatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2844 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQGIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2845 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtactggaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2846 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVLEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2847 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaagatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2848 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQKIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2849 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2850 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEQVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2851 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacatggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2852 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPHGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2853 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgagcttgaaatgaatgcagcggcggaagaactgatccagctgtgtcgcaacagcaacaagtacaag

SEQ ID NO: 2854 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIRELEMNAAAEELIQLCRNSNKYK

SEQ ID NO: 2855 - DNA, 1350 bp, Artificial Sequence
  "Variant of ADP-beta-1,2-glycosyltransferase"
atgcaccatcatcatgaaggcggtagcggccagaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2856 - protein, 450 aa, Artificial Sequence
  "Variant of ADP-beta-1,2-glycosyltransferase"
MHHHHEGGSGQTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2857 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtaccttttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2858 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVPFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2859 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtttaag

SEQ ID NO: 2860 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKFK

SEQ ID NO: 2861 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagccgtgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2862 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSRVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2863 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcgtaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2864 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILRNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2865 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagaccctaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggaaaagtacgcgacattagcaaaaacctgaagagcattcgcgaggaagaaatgaatgcagcggcggaagaactgatccagctgtgtcgcaacagcaacaagtacaag

SEQ ID NO: 2866 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDPNSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2867 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggtggaaatgaatgcagcggcggaagaactgatccagctgtgtcgcaacagcaacaagtacaag

SEQ ID NO: 2868 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREVEMNAAAEELIQLCRNSNKYK

SEQ ID NO: 2869 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcttgatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2870 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESLIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2871 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaaagtgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2872 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAESVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2873 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccggggactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2874 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPGTNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2875 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcgtgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2876 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKIVQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2877 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtagggatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2878 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSRRDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2879 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttatgcagtaccctgattaacctcgaaagcatcatcaagaagatcccggagaaatacagttctagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2880 - protein, 450 aa, Artificial Sequence
  "Variant of ADP-beta-1,2-glycosyltransferase"
MHHHHEGGSGSTLKVLMFPWLALGHINPFLNIAKQLADRGFLIYLCSTLINLESIIKKIPEKYSSSIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2881 - DNA, 1350 bp, Artificial Sequence
  "Variant of ADP-beta-1,2-glycosyltransferase"
atgcaccatcatcatgaaggcggtagcggctcgaccctgaaagtactgatgtttccgtggcttgcgctgggtcatattaacccgtttttgaacatcgctaaacaactggccgatcgtggtttcctgatctatttttgcagtaccctgattaacctcgaaagcatcatcaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatcgcttagcacctggcaatggaggtatcatgctgatgtgcacgagccgcgaaattgaggctaagtacctggactattgcaccgaactgagcaatgtaaaagttgttccggttggtccgccatttcaggacccgattactaatgatgcggacgacaaagaactgattgattggttaggcaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcattggtgatcgtggtcgcgttgtggaccattttgcaccgcagccgcgtattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgccgaaaccctgaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2882 - protein, 450 aa, Artificial Sequence
  "Variant of ADP-beta-1,2-glycosyltransferase"
MHHHHEGGSGSTLKVLMFPWLALGHINPFLNIAKQLADRGFLIYFCSTLINLESIIKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDRLAPGNGGIMLMCTSREIEAKYLDYCTELSNVKVVPVGPPFQDPITNDADDKELIDWLGTKDENSVVYVSFGSEYFLSREDMEEVAFGLELSNVNFIWVARFPKGEEQNLEDVLPKGFLERIGDRGRVVDHFAPQPRILNHPSTGGFISHCGWNSVMESIDFGVPIIAMPMQWDQPINAKLIVELGVAVEIVRDDDGNIHRGEIAETLKDVITGETGEILRGKVRDISKNLKSIREEEMNAAAEELIQLCRNSNKYK

SEQ ID NO: 2883 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2884 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2885 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccgtataccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcagcaacatattctgaaccatccgagcacgggtggcttcatctctcattgcggttggaacagcgtcatggaaagcattgatggaggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2886 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPYTNDADDKELIDWLGTKDENSVVYVSFGSEYFLSREDMEEVAFGLELSNVNFIWVARFPKGEEQNLEDVLPKGFLERVGDRGRVVDGMVPQQHILNHPSTGGFISHCGWNSVMESIDGGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2887 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgcgaacgaacagaacatcccggctgttaaaattctaacctcgggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttagataccaaagacgagaacagtgttgtctatgtgtcgtttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2888 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVANEQNIPAVKILTSGAALFSYFFNFLKRPGVEFPFPAINLSKVEQVKMREMMEKEPDEEDPLAPGNGGIMLMCTSREIEAKYLDYCTELSNVKVVPVGPPFQDPMTNDADDKELIDWLDTKDENSVVYVSFGSEYFLSREQMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2889 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgcagggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2890 - protein, 450 aa, Artificial Sequence
  "Variant of ADP-beta-1,2-glycosyltransferase"
MHHHHEGGSGSTLRVLMFPWLAQGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMMEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2891 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgcgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2892 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVANEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLDTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2893 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgcgaacgaacagaacatcccggctgttaaaattctaacctcgggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccggaaaccaatgatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggaatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2894 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVANEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPETNDADDKELIDWLDTKDENSVVYVSFGSEYFLSREDMEEVAFGLELSNVNFIWVARFPKGEEQNLEDVLPKGFLERVGDRGRVLDGMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2895 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaatatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcagcaacatattctgaaccatccgagcacgggtggcttcatctctcattgcggttggaacagcgtcatggaaagcattgatggaggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaaccattaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2896 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQQHILNHPSTGGFISHCGWNSVMESIDGGVPIIAMPMQWDQPINAKLIVELGVAVEIVRDDDGNIHRGEIAQTIKDVITGETGEILRGKVRDISKNLKSIREEEMNAAAEELIQLCRNSNKYK

SEQ ID NO: 2897 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaatatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgcgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggcgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatatcagactccgatggccaatgatgcggacgacaaagaactgattgattggttaggtaccaaagacgagaacagtgttgtctatgtgtcgtttggcagcgaatacttcctgagccgtgaacagatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggaatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2898 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVANEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPYQTPMANDADDKELIDWLGTKDENSVVYVSFGSEYFLSREQMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2899 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2900 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2901 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaatatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcagactccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2902 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2903 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaatatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaacctcgggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatatcagactccggaaaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggaatggtgccgcaggcccatattctgaaccatccgagcacgggtggcttcatctctcattgcggttggaacagcgtcatggaaagcattgatggaggcgttccgatcattgcgatgccgatgcagtgggatcagccgattaacgcgaagctgatcgtggaattaggcgttgcagtggagatcgtgcgtgatgatgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2904 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPYQTPETNDADDKELIDWLGTKDENSVVYVSFGSEYFLSREDMEEVAFGLELSNVNFIWVARFPKGEEQNLEDVLPKGFLERVGDRGRVLDGMVPQAHILNHPSTGGFISHCGWNSVMESIDGGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2905 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggaatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2906 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDGMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2907 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaatatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggcgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2908 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2909 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcagactccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2910 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2911 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgcagggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgatggaggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2912 - protein, 450 aa, Artificial Sequence
  "Variant of ADP-beta-1,2-glycosyltransferase"
MHHHHEGGSGSTLRVLMFPWLAQGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMMEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDGGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2913 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgaggcgatggaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggatccgtatgccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacatggtgccgcaggcgcatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2914 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREAMEKEPDEEDPLAPGNGGIMLMCTSREIEAKYLDYCTELSNVKVVPVGPPFQDPYANDADDKELIDWLGTKDENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2915 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagccgtcgcgaggaagaaatgaatgcagcggcggaagaactgatccagctgtgtcgcaacagcaacaagtacaag

SEQ ID NO: 2916 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSRREEEMNAAAEELIQLCRNSNKYK

SEQ ID NO: 2917 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagcgtattcgcgaggaagaaatgaatgcagcggcggaagaactgatccagctgtgtcgcaacagcaacaagtacaag

SEQ ID NO: 2918 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKRIREEEMNAAAEELIQLCRNSNKYK

SEQ ID NO: 2919 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtcatgaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2920 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGHEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2921 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgcggcagctgtgtcgcaacagcaacaagtacaag

SEQ ID NO: 2922 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELRQLCRNSNKYK

SEQ ID NO: 2923 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2924 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2925 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaagcgtgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2926 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKREQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2927 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtcgggaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2928 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGREFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2929 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaaccggaacaagtacaag

SEQ ID NO: 2930 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNRNKYK

SEQ ID NO: 2931 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaagtgcttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2932 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQVLKDVITGETGEILRGKVRDISKNLKSIREEEMNAAAEELIQLCRNSNKYK

SEQ ID NO: 2933 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcttgtacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2934 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVLYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2935 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaaggcgattcgcgaggaagaaatgaatgcagcggcggaagaactgatccagctgtgtcgcaacagcaacaagtacaag

SEQ ID NO: 2936 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKAIREEEMNAAAEELIQLCRNSNKYK

SEQ ID NO: 2937 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtatggaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2938 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGMEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2939 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaagaaggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2940 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKKEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2941 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaagaatgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2942 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKNEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2943 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaagttggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2944 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKLEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2945 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggcgcaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2946 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVAQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2947 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttcgggatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2948 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVRDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLKSIREEEMNAAAEELIQLCRNSNKYK

SEQ ID NO: 2949 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgaacatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtaaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgacgatggcaacattcaccgcggcgaaattgcccaaacccttaaagatgtgattaccggcgaaactggtgagatcctgcgcggcaaagtacgcgacattagcaaaaacctgcggagcattcgcgaggaagaaatgaatgcagcggcggaagaactgatccagctgtgtcgcaacagcaacaagtacaag

SEQ ID NO: 2950 - protein, 450 aa, Artificial Sequence
  "Variant of ADP-beta-1,2-glycosyltransferase"
MHHHHEGGSGSTLRVLMFPWLALGHINPFLNIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDDDGNIHRGEIAQTLKDVITGETGEILRGKVRDISKNLRSIREEEMNAAAEELIQLCRNSNKYK

SEQ ID NO: 2951 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaaactgagcaaggggaactttagcaagatcctgcagaacctgaagccggacctggtcatctacgattttctgcaaccgtgggcagaacatgtcgtgaatgaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2952 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKLSKGNFSKILQNLKPDLVIYDFLQPWAEHVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2953 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgaatgaacagaacatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcagtaacctgaagagcattcgcgagctggaaatgaatgcagcggcggaagaactgatccagctgtgtcgcaacagcaacaagtacaag

SEQ ID NO: 2954 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKRIPEKYSESIHLVELHLPELPELPPHYHTTNGLPPHLNGTLHKALKMSKPNFSKILQNLKPDLVIYDFLQPWAEQVVNEQNIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISSNLKSIRELEMNAAAEELIQLCRNSNKYK

SEQ ID NO: 2955 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaaaatgagcaagccaaactttagcaagatcctgcagaacctgaagccggacctggtcatctacgattttctgcaaccgtgggcagaacatgtcgtgctagaacaggggatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2956 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVLEQGIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIRELEMNAAAEELIQLCRNSNKYK

SEQ ID NO: 2957 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaaactgagcaaggggaactttagcaagatcctgcagaacctgaagccggacctggtcatctacgattttctgcaaccgtgggcagaacatgtcgtgaatgaacaggggatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2958 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKLSKGNFSKILQNLKPDLVIYDFLQPWAEHVVNEQGIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIRELEMNAAAEELIQLCRNSNKYK

SEQ ID NO: 2959 - DNA, 1350 bp, Artificial Sequence
  "Variant of ADP-beta-1,2-glycosyltransferase"
atgcaccatcatcatgaaggcggtagcggcagtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaaggggaactttagcaagatcctgcggaacctgaagccggacctggtcatctacgattttctgcaaccgtgggcagaacaggtcgtgaatgaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2960 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKGNFSKILRNLKPDLVIYDFLQPWAEQVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2961 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccaaactttagcaagatcctgcagaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2962 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2963 - DNA, 1350 bp, Artificial Sequence
  "Variant of ADP-beta-1,2-glycosyltransferase"
atgcaccatcatcatgaaggcggtagcggcagtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2964 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIRELEMNAAAEELIQLCRNSNKYK

SEQ ID NO: 2965 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2966 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2967 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacatgtcgtgctagaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2968 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEHVVLEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2969 - DNA, 1350 bp, Artificial Sequence
  "Variant of ADP-beta-1,2-glycosyltransferase"
atgcaccatcatcatgaaggcggtagcggcagtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaaactgagcaagccaaactttagcaagatcctgcggaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2970 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKRIPEKYSESIHLVELHLPELPELPPHYHTTNGLPPHLNGTLHKALKLSKPNFSKILRNLKPDLVIYDFLQPWAEHVVNEQNIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2971 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaatgaacagaagatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2972 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQKIPAVKILTSGAALFSYFFNFLKRPGVPFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2973 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtaatagcatccatctggttgagctgcatctgccagaattaccggaactgccaccacattaccatactaccaacggtttaccaccgcatctgaacgggaccctgcacaaggcactgaagatgagcaaggggaactttagcaagatcctgcagaacctgaagccggacctggtcatctacgattttctgcaaccgtgggcagaacatgtcgtgctagaacagaacatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2974 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEHVVLEQNIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIRELEMNAAAEELIQLCRNSNKYK

SEQ ID NO: 2975 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatctgtgcagtaccctgattaacctcgaaagcatcaaaaagaagatcccggagaaatacagtgaaagcatccatctggttgagctgcatctgccagaattaccggaactgccaccacattaccatactaccaacggtttaccaccgcatctgaacgggaccctgcacaaggcactgaaaatgagcaaggggaactttagcaagatcctgcagaacctgaagccggacctggtcatctacgattttctgcaaccgtgggcagaacatgtcgtgaatgaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2976 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKGNFSKILQNLKPDLVIYDFLQPWAEHVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2977 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgctagaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2978 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEHVVLEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2979 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgaatgaacagaacatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2980 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIRELEMNAAAEELIQLCRNSNKYK

SEQ ID NO: 2981 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatctgtgcagtaccctgattaacctcgaaagcatcaaaaagaaaatcccggagaaatacagtgaaagcatccatctggttgagctgcatctgccagaattaccggaactgccaccacattaccatactaccaacggtttaccaccgcatctgaacgggaccctgcacaaggcactgaaactgagcaagccaaactttagcaagatcctgcagaacctgaagccggacctggtcatctacgattttctgcaaccgtgggcagaacaggtcgtgaatgaacagaagatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2982 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKLSKPNFSKILQNLKPDLVIYDFLQPWAEQVVNEQKIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2983 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaaaatgagcaagccaaactttagcaagatcctgcggaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttagataccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2984 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILRNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLDTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2985 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaaactgagcaagccaaactttagcaagatcctgcagaacctgaagccggacctggtcatctacgattttctgcaaccgtgggcagaacaggtcgtgaatgaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2986 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKKIPEKYSESIHLVELHLPELPELPPHYHTTNGLPPHLNGTLHKALKLSKPNFSKILQNLKPDLVIYDFLQPWAEQVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2987 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgagagcatccatctggttgagctgcatctgccagaattaccggaactgccaccacattaccatactaccaacggtttaccaccgcatctgaacgggaccctgcacaaggcactgaaactgagcaaggggaactttagcaagatcctgcggaacctgaagccggacctggtcatctacgattttctgcaaccgtgggcagaacatgtcgtgaatgaacagaagatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2988 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKRIPEKYSESIHLVELHLPELPELPPHYHTTNGLPPHLNGTLHKALKLSKGNFSKILRNLKPDLVIYDFLQPWAEHVVNEQKIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2989 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatgtgtgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgaatgaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 2990 - protein, 450 aa, Artificial Sequence
  "Variant of ADP-beta-1,2-glycosyltransferase"
MHHHHEGGSGGTLRVLMFPWLALGHINPFLRIAKQLADRGFLIYVCSTLINLESIKKRIPEKYSESIHLVELHLPELPELPPHYHTTNGLPPHLNGTLHKALKMSKPNFSKILQNLKPDLVIYDFLQPWAEQVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2991 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtgaaagcatccatctggttgagctgcatctgccagaattaccggaactgccaccacattaccatactaccaacggtttaccaccgcatctgaacgggaccctgcacaaggcactgaaaatgagcaaggggaactttagcaagatcctgcggaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 2992 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKKIPEKYSESIHLVELHLPELPELPPHYHTTNGLPPHLNGTLHKALKMSKGNFSKILRNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIRELEMNAAAEELIQLCRNSNKYK

SEQ ID NO: 2993 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacaggtcgtgctagaacagaagatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2994 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEQVVLEQKIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2995 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgaaagcatccatctggttgagctgcatctgccagaattaccggaactgccaccacattaccatactaccaacggtttaccaccgcatctgaacgggaccctgcacaaggcactgaaaatgagcaagccaaactttagcaagatcctgcagaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccagaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2996 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPEGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 2997 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatctgtgcagtaccctgattaacctcgaaagcatcaaaaagaaaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacaggtcgtgaatgaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 2998 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEQVVNEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 2999 - DNA, 1350 bp, Artificial Sequence
  "Variant of ADP-beta-1,2-glycosyltransferase"
atgcaccatcatcatgaaggcggtagcggcagtaccctgagagtactgatgtttccgtggcttgcgctgggtcatattaacccgtttttgcgtatcgctaaacaactggccgatcgtggtttcctgatctatctgtgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccaaactttagcaagatcctgcagaacctgaagccggacctggtcatctacgattttctgcaaccgtgggcagaacatgtcgtgaatgaacagaagatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 3000 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEHVVNEQKIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 3001 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaaggggaactttagcaagatcctgcagaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 3002 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKGNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIRELEMNAAAEELIQLCRNSNKYK

SEQ ID NO: 3003 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaaaatgagcaagccaaactttagcaagatcctgcagaacctgaagccggacctggtcatctacgattttctgcaaccgtgggcagaacatgtcgtgaatgaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccagaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3004 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSESIHLVELHLPELPELPPHYHTTNGLPPHLNGTLHKALKMSKPNFSKILQNLKPDLVIYDFLQPWAEHVVNEQGIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPEGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 3005 - DNA, 1350 bp, Artificial Sequence
  "Variant of ADP-beta-1,2-glycosyltransferase"
atgcaccatcatcatgaaggcggtagcggcggtaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtgaaagcatccatctggttgagctgcatctgccagaattaccggaactgccaccacattaccatactaccaacggtttaccaccgcatctgaacgggaccctgcacaaggcactgaagatgagcaagccgaactttagcaagatcctgcggaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccacacggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 3006 - protein, 450 aa, Artificial Sequence
  "Variant of ADP-beta-1,2-glycosyltransferase"
MHHHHEGGSGGTLRVLMFPWLALGHINPFLRIAKQLADRGFLIYLCSTLINLESIKKRIPEKYSESIHLVELHLPELPELPPHYHTTNGLPPHLNGTLHKALKMSKPNFSKILRNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSRVNFIWVARFPKGEEQNLEDVLPHGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3007 - DNA, 1350 bp, Artificial Sequence
  "Variant of ADP-beta-1,2-glycosyltransferase"
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaatgaacaggggatcccggctgttaaaattctaaccagtggtgcggcactgtttagctactttttcaacttcctgaagcgaccgggtgtaccgtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 3008 - protein, 450 aa, Artificial Sequence
  "Variant of ADP-beta-1,2-glycosyltransferase"
MHHHHEGGSGSTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEHVVNEQGIPAVKILTSGAALFSYFFNFLKRPGVPFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 3009 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaaaatgagcaagccaaactttagcaagatcctgcagaacctgaagccggacctggtcatctacgattttctgcaaccgtgggcagaacaggtcgtgctagaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 3010 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLDTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 3011 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccaaactttagcaagatcctgcggaacctgaagccggacctggtcatctacgattttctgcaaccgtgggcagaacatgtcgtgctagaacaggggatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3012 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILRNLKPDLVIYDFLQPWAEHVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 3013 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaaggggaactttagcaagatcctgcagaacctgaagccggacctggtcatctacgattttctgcaaccgtgggcagaacatgtcgtgctagaacagaacatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagccgggtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgagctggaaatgaatgcagcggcggaagaactgatccagctgtgtcgcaacagcaacaagtacaag

SEQ ID NO: 3014 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVIYDFLQPWAEHVVLEQNIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSRVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIRELEMNAAAEELIQLCRNSNKYK

SEQ ID NO: 3015 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3016 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3017 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaacagcaacaagtacaag

SEQ ID NO: 3018 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELRQLCRNSNKYK

SEQ ID NO: 3019 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatacagctgtgtcgcaaccgcaacaagtacaag

SEQ ID NO: 3020 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNRNKYK

SEQ ID NO: 3021 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagaagcagacgcgaggaggaaatgaatgcagcggcggaagaactgagacagctgtgtcgcaaccgcaacaagtacaag

SEQ ID NO: 3022 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRSRREEEMNAAAEELRQLCRNRNKYK

SEQ ID NO: 3023 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3024 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3025 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3026 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3027 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccacatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3028 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3029 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatacagctgtgtcgcaaccgcaacaagtacaag

SEQ ID NO: 3030 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNRNKYK

SEQ ID NO: 3031 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3032 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3033 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3034 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3035 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3036 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3037 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagaagcatacgcgaggaggaaatgaatgcagcggcggaagaactgatacagctgtgtcgcaaccgcaacaagtacaag

SEQ ID NO: 3038 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRSIREEEMNAAAEELIQLCRNRNKYK

SEQ ID NO: 3039 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggtctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagaagcatacgcgaggaggaaatgaatgcagcggcggaagaactgagacagctgtgtcgcaaccgcaacaagtacaag

SEQ ID NO: 3040 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDGLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRSIREEEMNAAAEELRQLCRNRNKYK

SEQ ID NO: 3041 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatacagctgtgtcgcaacagcaacaagtacaag

SEQ ID NO: 3042 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3043 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3044 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3045 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaacagcaacaagtacaag

SEQ ID NO: 3046 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELRQLCRNSNKYK

SEQ ID NO: 3047 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgagagcgatacgcgaggaggaaatgaatgcagcggcggaagaactgatacagctgtgtcgcaaccgcaacaagtacaag

SEQ ID NO: 3048 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLRAIREEEMNAAAEELIQLCRNRNKYK

SEQ ID NO: 3049 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaaccgcaacaagtacaag

SEQ ID NO: 3050 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELRQLCRNRNKYK

SEQ ID NO: 3051 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaacagcaacaagtacaag

SEQ ID NO: 3052 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELRQLCRNSNKYK

SEQ ID NO: 3053 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaaacgcagacgcgaggaggaaatgaatgcagcggcggaagaactgatacagctgtgtcgcaacagcaacaagtacaag

SEQ ID NO: 3054 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDGLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKRRREEEMNAAAEELIQLCRNSNKYK

SEQ ID NO: 3055 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaaccgcaacaagtacaag

SEQ ID NO: 3056 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELRQLCRNRNKYK

SEQ ID NO: 3057 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaaaagcatacgcgaggaggaaatgaatgcagcggcggaagaactgatccagctgtgtcgcaacagcaacaagtacaag

SEQ ID NO: 3058 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3059 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagacgcatacgcgaggaggaaatgaatgcagcggcggaagaactgagacagctgtgtcgcaaccgcaacaagtacaag

SEQ ID NO: 3060 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRRIREEEMNAAAEELRQLCRNRNKYK

SEQ ID NO: 3061 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaaccgcaacaagtacaag

SEQ ID NO: 3062 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELRQLCRNRNKYK

SEQ ID NO: 3063 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgggccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgagacgcatacgcgaggaggaaatgaatgcagcggcggaagaactgatccagctgtgtcgcaacagcaacaagtacaag

SEQ ID NO: 3064 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLGREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLRRIREEEMNAAAEELIQLCRNSNKYK

SEQ ID NO: 3065 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3066 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3067 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3068 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3069 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatacagctgtgtcgcaacagcaacaagtacaag

SEQ ID NO: 3070 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNSNKYK

SEQ ID NO: 3071 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccacctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3072 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3073 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtcgaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccacctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3074 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3075 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgatacagctgtgtcgcaaccgcaacaagtacaag

SEQ ID NO: 3076 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELIQLCRNRNKYK

SEQ ID NO: 3077 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgagaagcagacgcgaggaggaaatgaatgcagcggcggaagaactgatacagctgtgtcgcaacagcaacaagtacaag

SEQ ID NO: 3078 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGHEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLRSRREEEMNAAAEELIQLCRNSNKYK

SEQ ID NO: 3079 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggcaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagaagcagacgcgaggaggaaatgaatgcagcggcggaagaactgagacagctgtgtcgcaacagcaacaagtacaag

SEQ ID NO: 3080 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKGNFSKILQNLKPDLVIYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRSRREEEMNAAAEELRQLCRNSNKYK

SEQ ID NO: 3081 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3082 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3083 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcatttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3084 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3085 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgagacgcatacgcgaggaggaaatgaatgcagcggcggaagaactgatacagctgtgtcgcaaccgcaacaagtacaag

SEQ ID NO: 3086 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLRRIREEEMNAAAEELIQLCRNRNKYK

SEQ ID NO: 3087 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgaagagcattcgcgaggaggaaatgaatgcagcggcggaagaactgagacagctgtgtcgcaacagcaacaagtacaag

SEQ ID NO: 3088 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLKSIREEEMNAAAEELRQLCRNSNKYK

SEQ ID NO: 3089 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaaagcgagacgcgaggaggaaatgaatgcagcggcggaagaactgatacagctgtgtcgcaacagcaacaagtacaag

SEQ ID NO: 3090 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDGMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKARREEEMNAAAEELIQLCRNSNKYK

SEQ ID NO: 3091 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggaaaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggattccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacgcctacaag

SEQ ID NO: 3092 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNAYK

SEQ ID NO: 3093 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacagggggttccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3094 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGVPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLDTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3095 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacaggtcgtgctagaacaggggattccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacgcctacaag

SEQ ID NO: 3096 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNAYK

SEQ ID NO: 3097 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacagctggccgatcgtggtttcctgatctatttatgcagtaccctgattaacctcgaaagcatcaaaaagaaaatcccggaaaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcagaacctgaagccggacctggtcatctacgattttctgcaaccgtgggcagaacaggtcgtgctagaacagggggttccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3098 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGVPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3099 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggattccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagcgggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3100 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKERDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3101 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccgaggatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3102 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3103 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgattatgacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3104 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDYDDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3105 - DNA, 1350 bp, Artificial Sequence
  "Variant of ADP-beta-1,2-glycosyltransferase"
atgcaccatcatcatgaaggcggttgtggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3106 - protein, 450 aa, Artificial Sequence
  "Variant of ADP-beta-1,2-glycosyltransferase"
MHHHHEGGCGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3107 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgtgattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3108 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSRVIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3109 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcccgactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3110 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGPTGEILRGKVRDISKNLKSIREEEMNAAAEELIQLCRNSNKYK

SEQ ID NO: 3111 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatacgggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3112 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNTGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3113 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaggctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3114 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQRLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3115 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaggctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3116 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAIRLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3117 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatattgacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3118 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDIDDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3119 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacgtgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3120 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNVKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3121 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgccggaaagtacgcgacattagcaaaaacctgaagagcattcgcgaggaggaaatgaatgcagcggcggaagaactgatccagctgtgtcgcaacagcaacaagtacaag

SEQ ID NO: 3122 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRRKVRDISKNLKSIREEEMNAAAEELIQLCRNSNKYK

SEQ ID NO: 3123 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacatggaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3124 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDMELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3125 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatgcgggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3126 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNAGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3127 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtcagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3128 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGQILRGKVRDISKNLKSIREEEMNAAAEELIQLCRNSNKYK

SEQ ID NO: 3129 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgagggtaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3130 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEGKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3131 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcaagaaagtacgcgacattagcaaaaacctgaagagcattcgcgaggaggaaatgaatgcagcggcggaagaactgatccagctgtgtcgcaacagcaacaagtacaag

SEQ ID NO: 3132 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRKKVRDISKNLKSIREEEMNAAAEELIQLCRNSNKYK

SEQ ID NO: 3133 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaactgggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3134 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGELGEILRGKVRDISKNLKSIREEEMNAAAEELIQLCRNSNKYK

SEQ ID NO: 3135 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaacggctgaagagcattcgcgaggaggaaatgaatgcagcggcggaagaactgatccagctgtgtcgcaacagcaacaagtacaag

SEQ ID NO: 3136 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKRLKSIREEEMNAAAEELIQLCRNSNKYK

SEQ ID NO: 3137 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgtagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatctcgctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3138 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAISLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3139 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagttcgagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3140 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSSSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3141 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcgcgccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggtcggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3142 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSAPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3143 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaaaaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3144 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEKVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3145 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaagctctgaagagcattcgcgaggaggaaatgaatgcagcggcggaagaactgatccagctgtgtcgcaacagcaacaagtacaag

SEQ ID NO: 3146 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKALKSIREEEMNAAAEELIQLCRNSNKYK

SEQ ID NO: 3147 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagccgtaagtacaag

SEQ ID NO: 3148 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSRKYK

SEQ ID NO: 3149 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaacctgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3150 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3151 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgacctgtgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3152 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTCDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3153 - DNA, 1350 bp, Artificial Sequence
  "Variant of ADP-beta-1,2-glycosyltransferase"
atgcaccatcatcatgaaggcggtatgggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3154 - protein, 450 aa, Artificial Sequence
  "Variant of ADP-beta-1,2-glycosyltransferase"
MHHHHEGGMGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3155 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccgtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaacgtctgaagagcattcgcgaggaggaaatgaatgcagcggcggaagaactgatccagctgtgtcgcaacagcaacaagtacaag

SEQ ID NO: 3156 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDRMVPQAHILNHPSTGGFISHCGWNSVMESIDFGVPIIAMPMQWDQPINAKLIVELGVAVEIVRDEDGRIHRGEIAQTLKDVITGETGEILRGKVRDISKRLKSIREEEMNAAAEELIQLCRNSNKYK

SEQ ID NO: 3157 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagccttaagtacaag

SEQ ID NO: 3158 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSLKYK

SEQ ID NO: 3159 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggccgggtacgcgacattagcaaaaacctgaagagcattcgcgaggaggaaatgaatgcagcggcggaagaactgatccagctgtgtcgcaacagcaacaagtacaag

SEQ ID NO: 3160 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGRVRDISKNLKSIREEEMNAAAEELIQLCRNSNKYK

SEQ ID NO: 3161 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatccggcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3162 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIRRDEDGRIHRGEIAQTLKDVITGETGEILRGKVRDISKNLKSIREEEMNAAAEELIQLCRNSNKYK

SEQ ID NO: 3163 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaagatctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3164 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQDLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3165 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgacccttgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3166 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTLDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3167 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcctgattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3168 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSRLIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3169 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcgcgaaagtacgcgacattagcaaaaacctgaagagcattcgcgaggaggaaatgaatgcagcggcggaagaactgatccagctgtgtcgcaacagcaacaagtacaag

SEQ ID NO: 3170 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRAKVRDISKNLKSIREEEMNAAAEELIQLCRNSNKYK

SEQ ID NO: 3171 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatgttggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3172 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNVGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3173 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccccggatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3174 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTPDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3175 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccgtggatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3176 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTVDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRGKVRDISKNLKSIREEEMNAAAEELIQLCRNSNKYK

SEQ ID NO: 3177 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagcgtctgcgcggcaaagtacgcgacattagcaaaaacctgaagagcattcgcgaggaggaaatgaatgcagcggcggaagaactgatccagctgtgtcgcaacagcaacaagtacaag

SEQ ID NO: 3178 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGERLRGKVRDISKNLKSIREEEMNAAAEELIQLCRNSNKYK

SEQ ID NO: 3179 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaaaatcccggagaaatacagtaatagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaaacccttaaagatgtgattaccggcgaaactggtgagatcctgcgccataaagtacgcgacattagcaaaaacctgaagagcattcgcgaggaggaaatgaatgcagcggcggaagaactgatccagctgtgtcgcaacagcaacaagtacaag

SEQ ID NO: 3180 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKKIPEKYSNSIHLVELHLPELPELPPHYHTTNGLPPHLNGTLHKALKMSKPNFSKILQNLKPDLVIYDFLQPWAEQVVLEQGIPAVKILTSGAALFSYFFNFLKRPGVEFPFPAINLSKVEQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQTLKDVITGETGEILRHKVRDISKNLKSIREEEMNAAAEELIQLCRNSNKYK

SEQ ID NO: 3181 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3182 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3183 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacaagtacaag

SEQ ID NO: 3184 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKEPDEEDPLAPGNAGIMLMCTSREIEAKYLDYCTELTNVKVVPVGPPFQTPMTEDADDKELIDWLGTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3185 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgagacagctgtgtcgcaaccgcaacaagtacaag

SEQ ID NO: 3186 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELRQLCRNRNKYK

SEQ ID NO: 3187 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaacgactgagagcgagacgcgaggaggaaatgaatgcagcggcggaagaactgatacagctgtgtcgcaaccgcaacaagtacaag

SEQ ID NO: 3188 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGRVRDISKRLRARREEEMNAAAEELIQLCRNRNKYK

SEQ ID NO: 3189 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3190 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3191 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggtctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3192 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGVPAVKILTSGAALFSYFFNFLKRPGVEFPFPAINLSKREQVKMREMFEKEPDEEDPLAPGNAGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVLDGLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3193 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3194 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3195 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagcgggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3196 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKERDEEDPLAPGNGGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3197 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacaagtacaag

SEQ ID NO: 3198 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3199 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgagacagctgtgtcgcaaccgcaacaagtacaag

SEQ ID NO: 3200 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELRQLCRNRNKYK

SEQ ID NO: 3201 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgagacagctgtgtcgcaaccgcaacgcctacaag

SEQ ID NO: 3202 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGVPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELRQLCRNRNAYK

SEQ ID NO: 3203 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacaagtacaag

SEQ ID NO: 3204 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3205 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacaagtacaag

SEQ ID NO: 3206 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3207 - DNA, 1350 bp, Artificial Sequence
  "Variant of ADP-beta-1,2-glycosyltransferase"
atgcaccatcatcatgaaggcggtagcggccagagcctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgagacagctgtgtcgcaaccgcaacaagtacaag

SEQ ID NO: 3208 - protein, 450 aa, Artificial Sequence
  "Variant of ADP-beta-1,2-glycosyltransferase"
MHHHHEGGSGQSLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELRQLCRNRNKYK

SEQ ID NO: 3209 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3210 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3211 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgagacagctgtgtcgcaaccgcaacgcctacaag

SEQ ID NO: 3212 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGHEFPFPAINLSKREQVKMREMFEKEPDEEDPLAPGNAGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELRQLCRNRNAYK

SEQ ID NO: 3213 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagcgggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccaaagtacgcgacattagcaaacgactgagagcgagacgcgaggaggaaatgaatgcagcggcggaagaactgatacagctgtgtcgcaaccgcaacaagtacaag

SEQ ID NO: 3214 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKERDEEDPLAPGNGGIMLMCTSREIEAKYLDYCTELTNVKVVPVGPPFQDPMTEDADDKELIDWLDTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRAKVRDISKRLRARREEEMNAAAEELIQLCRNRNKYK

SEQ ID NO: 3215 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgagacagctgtgtcgcaaccgcaacaagtacaag

SEQ ID NO: 3216 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSREIEAKYLDYCTELTNVKVVPVGPPFQTPMTNDADDKELIDWLGTKPENSVVYVSFGSEYFLSREDMEEVAFGLELSNVNFIWVARFPKGEEQNLEDVLPKGFLERVGDRGRVLDGMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELRQLCRNRNKYK

SEQ ID NO: 3217 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3218 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3219 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgagacagctgtgtcgcaaccgcaacgcctacaag

SEQ ID NO: 3220 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELRQLCRNRNAYK

SEQ ID NO: 3221 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagcgggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3222 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKERDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3223 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagcgggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggacggtctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacatcagcaaaaacctgagagcgagacgcgaggaggaaatgaatgcagcggcggaagaactgatacagctgtgtcgcaaccgcaacgcctacaag

SEQ ID NO: 3224 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKERDEEDPLAPGNAGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDGLVPQAHILNHPSTGGFISHCGWNSVMESIDFGVPIIAMPMQWDQPINAKLIVELGVAVEIVRDEDGRIHRGEIAQVLKDVITGETGEILRGRVRDISKNLRARREEEMNAAAEELIQLCRNRNAYK

SEQ ID NO: 3225 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3226 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTEDADDKELIDWLDTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3227 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgatacagctgtgtcgcaaccgcaacaagtacaag

SEQ ID NO: 3228 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELIQLCRNRNKYK

SEQ ID NO: 3229 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3230 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGHEFPFPAINLSKREQVKMREMFEKEPDEEDPLAPGNGGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3231 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttagataccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacgcctacaag

SEQ ID NO: 3232 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNAYK

SEQ ID NO: 3233 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaacgactgagagcgagacgcgaggaggaaatgaatgcagcggcggaagaactgagacagctgtgtcgcaaccgcaacaagtacaag

SEQ ID NO: 3234 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGHEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGRVRDISKRLRARREEEMNAAAEELRQLCRNRNKYK

SEQ ID NO: 3235 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccaaagtacgcgacattagcaaaaacctgagagcgagacgcgaggaggaaatgaatgcagcggcggaagaactgatacagctgtgtcgcaaccgcaacgcctacaag

SEQ ID NO: 3236 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3237 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgatacagctgtgtcgcaaccgcaacaagtacaag

SEQ ID NO: 3238 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLDTKPENSVVYVSFGSEYFLSREDMEEVAFGLELSNVNFIWVARFPKGEEQNLEDVLPKGFLERVGDRGRVLDHMVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELIQLCRNRNKYK

SEQ ID NO: 3239 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3240 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3241 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggacggtatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaaaacctgagagcgagacgcgaggaggaaatgaatgcagcggcggaagaactgagacagctgtgtcgcaaccgcaacaagtacaag

SEQ ID NO: 3242 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNAGIMLMCTSREIEAKYLDYCTELTNVKVVPVGPPFQTPMTEDADDKELIDWLGTKDENSVVYVSFGSEYFLSREDMEEVAFGLELSNVNFIWVARFPKGEEQNLEDVLPKGFLERVGDRGRVVDGMVPQAHILNHPSTGGFISHCGWNSVMESIDFGVPIIAMPMQWDQPINAKLIVELGVAVEIVRDEDGRIHRGEIAQVLKDVITGETGEILRGRVRDISKNLRARREEEMNAAAEELRQLCRNRNKYK

SEQ ID NO: 3243 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3244 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3245 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaaaacctgagagcgagacgcgaggaggaaatgaatgcagcggcggaagaactgatacagctgtgtcgcaaccgcaacaagtacaag

SEQ ID NO: 3246 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGRVRDISKNLRARREEEMNAAAEELIQLCRNRNKYK

SEQ ID NO: 3247 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatgccggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccaaagtacgcgacattagcaaaaacctgagagcgagacgcgaggaggaaatgaatgcagcggcggaagaactgatacagctgtgtcgcaaccgcaacgcctacaag

SEQ ID NO: 3248 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNAGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELIQLCRNRNAYK

SEQ ID NO: 3249 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgatacagctgtgtcgcaaccgcaacgcctacaag

SEQ ID NO: 3250 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELIQLCRNRNAYK

SEQ ID NO: 3251 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3252 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3253 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccaaagtacgcgacattagcaaaaacctgagagcgagacgcgaggaggaaatgaatgcagcggcggaagaactgagacagctgtgtcgcaaccgcaacaagtacaag

SEQ ID NO: 3254 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDEDGRIHRGEIAQVLKDVITGETGEILRAKVRDISKNLRARREEEMNAAAEELRQLCRNRNKYK

SEQ ID NO: 3255 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3256 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGVPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3257 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttagataccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacgcctacaag

SEQ ID NO: 3258 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLDTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNAYK

SEQ ID NO: 3259 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3260 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3261 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcagacgccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcgccagagtacgcgacattagcaaaaacctgagagcgagacgcgaggaggaaatgaatgcagcggcggaagaactgatacagctgtgtcgcaaccgcaacaagtacaag

SEQ ID NO: 3262 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQTPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRARVRDISKNLRARREEEMNAAAEELIQLCRNRNKYK

SEQ ID NO: 3263 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagggaaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgagacagctgtgtcgcaaccgcaacaagtacaag

SEQ ID NO: 3264 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKGNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELRQLCRNRNKYK

SEQ ID NO: 3265 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaaaacctgagagcgagacgcgaggaggaaatgaatgcagcggcggaagaactgatacagctgtgtcgcaaccgcaacgcctacaag

SEQ ID NO: 3266 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGRVRDISKNLRARREEEMNAAAEELIQLCRNRNAYK

SEQ ID NO: 3267 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtcatgagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3268 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGHEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3269 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacagggggttccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagcgggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcagagtacgcgacattagcaaaaacctgagagcgagacgcgaggaggaaatgaatgcagcggcggaagaactgatacagctgtgtcgcaaccgcaacaagtacaag

SEQ ID NO: 3270 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGVPAVKILTSGAALFSYFFNFLKRPGVEFPFPAINLSKREQVKMREMFEKERDEEDPLAPGNGGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDEDGRIHRGEIAQVLKDVITGETGEILRGRVRDISKNLRARREEEMNAAAEELIQLCRNRNKYK

SEQ ID NO: 3271 - DNA, 1350 bp, Artificial Sequence
  "Variant of ADP-beta-1,2-glycosyltransferase"
atgcaccatcatcatgaaggcagcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgattgagagcgagacgcgaggaggaaatgaatgcagcggcggaagaactgatacagctgtgtcgcaaccgcaacaagtacaag

SEQ ID NO: 3272 - protein, 450 aa, Artificial Sequence
  "Variant of ADP-beta-1,2-glycosyltransferase"
MHHHHEGSSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3273 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaacccgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaacgactgagagcgagacgcgaggaggaaatgaatgcagcggcggaagaactgatacagctgtgtcgcaaccgcaacaagtacaag

SEQ ID NO: 3274 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKPENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKRLRARREEEMNAAAEELIQLCRNRNKYK

SEQ ID NO: 3275 - DNA, 1350 bp, Artificial Sequence
  "Variant of ADP-beta-1,2-glycosyltransferase"
atgcaccatcatcatgaaggcggcagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatctggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3276 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHLVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3277 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggattccggctgttaaaattctaaccagtggtgcggcactgtttagctactttttcaacttcctgaagcgaccgggtgtggagtttccgtttccggcgatcaacctgtcgaagcgagaacaggtgaagatgcgcgagatgtttgaaaaggagccggatgaagaagatccgttagcacctggcaatggcggtatcatgctgatgtgcacgagccgcgaaattgaggctaagtacctggactattgcaccgaactgaccaatgtaaaagttgttccggttggtccgccatttcaggatccgatgaccgaagatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3278 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTEDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3279 - DNA, 1347 bp, Artificial Sequence
  "Variant of ADP-beta-1,2-glycosyltransferase"
atgcatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3280 - protein, 449 aa, Artificial Sequence
  "Variant of ADP-beta-1,2-glycosyltransferase"
MHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3281 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctactttttcaacttcctgtctcgcccgggtgtagagtttccgtttccggcgatcaacctgtcgaagcgagaacaggtgaagatgcgcgagatgtttgaaaaggagccggatgaagaagatccgttagcacctcacaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3282 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYFFNFLSRPGVEFPFPAINLSKREQVKMREMFEKEPDEEDPLAPHNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3283 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaagcgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3284 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLSTPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3285 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctcacaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3286 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLSTPGVEFPFPAINLSKREQVKMREMFEKEPDEEDPLAPHNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3287 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgtctcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3288 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLSRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3289 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaagcgtgggcagaacaggtcgtgctagaacaggggatcccggctgttaaaattctaaccagtggtgcggcactgtttagctactttttcaacttcctgtctggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3290 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLSGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3291 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgtctcgcccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3292 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLSRPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3293 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgaagggcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3294 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLKGPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3295 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctcacgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3296 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLKRPGVEFPFPAINLSKREQVKMREMFEKEPDEEDPLAPHAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3297 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctactttttcaacttcctgaagggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3298 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYFFNFLKGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3299 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaaccgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3300 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQPWAEQVVLEQGIPAVKILTSGAALFSYFFNFLKRPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3301 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctactttttcaacttcctgtctcgcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3302 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYFFNFLSRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3303 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaaccgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3304 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQPWAEQVVLEQGIPAVKILTSGAALFSYFFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3305 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctaccgcttcaacttcctgaagactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3306 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLKTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3307 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctaccgcttcaacttcctgtctcgcccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3308 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYRFNFLSRPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3309 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctaccgcttcaacttcctgaagggcccgggtgtagagtttccgtttccggcgatcaacctgtcgaagcgagaacaggtgaagatgcgcgagatgtttgaaaaggagccggatgaagaagatccgttagcacctcacgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3310 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLKGPGVEFPFPAINLSKREQVKMREMFEKEPDEEDPLAPHAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3311 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctactttttcaacttcctgaagactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3312 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYFFNFLKTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3313 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctactttttcaacttcctgtctcgcccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3314 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYFFNFLSRPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3315 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgtctcgcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3316 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLSRPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3317 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctgttcctttacgattttcatcaagcgtgggcagaacaggtcgtgctagaacaggggatcccggctgttaaaattctaaccagtggtgcggcactgtttagctactttttcaacttcctgaagactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3318 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLFLYDFHQAWAEQVVLEQGIPAVKILTSGAALFSYFFNFLKTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3319 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgaagcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3320 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3321 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagtacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3322 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYFFNFLKRPGVEFPFPAINLSKREQVKMREMFEKEPDEEDPLVPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3323 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctaccgcttcaacttcctgtctggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3324 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLSGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3325 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctactttttcaacttcctgtctggcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3326 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYFFNFLSGPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3327 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgaagactccgggtgtagagtttccgtttccggcgatcaacctgtcgaagcgagaacaggtgaagatgcgcgagatgtttgaaaaggagccggatgaagaagatccgttagcacctcacgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3328 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLKTPGVEFPFPAINLSKREQVKMREMFEKEPDEEDPLAPHAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3329 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3330 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3331 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3332 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3333 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctcacaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3334 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLSTPGVEFPFPAINLSKREQVKMREMFEKEPDEEDPLAPHNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3335 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctaccgcttcaacttcctgaagactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3336 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYRFNFLKTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3337 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctactttttcaacttcctgaagcgaccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3338 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYFFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3339 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgaagactccgggtgtagagtttccgtttccggcgatcaacctgtcgaagcgagaacaggtgaagatgcgcgagatgtttgaaaaggagccggatgaagaagatccgttagcacctcccaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3340 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKTPGVEFPFPAINLSKREQVKMREMFEKEPDEEDPLAPPNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3341 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaaccgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3342 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQPWAEQVVLEQGIPAVKILTSGAALFSYFFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3343 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaaccgtgggcagaacaggtcgtgctagaacaggggatcccggctgttaaaattctaaccagtggtgcggcactgtttagctactttttcaacttcctgaagcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3344 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3345 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3346 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYRFNFLSTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3347 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaaccgtgggcagaacaggtcgtgctagaacaggggatcccggctgttaaaattctaaccagtggtgcggcactgtttagctactttttcaacttcctgtctggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3348 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLSGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3349 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaaccgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3350 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYFFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQNINAKLIVELGVAVEIVRDEDGRIHRGEIAQVLKDVITGETGEILRGKVRDISKNLRARREEEMNAAAEELIQLCRNRNKYK

SEQ ID NO: 3351 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttctgcaagcgtgggcagaacaggtcgtgctagaacaggggatcccggctgttaaaattctaaccagtggtgcggcactgtttagctaccgcttcaacttcctgaagactccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3352 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQAWAEQVVLEQGIPAVKILTSGAALFSYRFNFLKTPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3353 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctaccgcttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3354 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFHQAWAEQVVLEQGIPAVKILTSGAALFSYRFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3355 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaaccgtgggcagaacaggtcgtgctagaacaggggatcccggctgttaaaattctaaccagtggtgcggcactgtttagctactttttcaacttcctgaagggcccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3356 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQPWAEQVVLEQGIPAVKILTSGAALFSYFFNFLKGPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3357 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcttcaaccgtgggcagaacaggtcgtgctagaacaggggatcccggctgttaaaattctaaccagtggtgcggcactgtttagctaccgcttcaacttcctgaagcgcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3358 - protein, 450 aa, Artificial Sequence
  "Variant of ADP-beta-1,2-glycosyltransferase"
MHHHHEGGSGQTLRVLMFPWLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFLQPWAEQVVLEQGIPAVKILTSGAALFSYRFNFLKRPGVEFPFPAINLSKREQVKMREMFEKEPDEEDPLAPGAGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3359 - DNA, 1350 bp, Artificial Sequence
  "Variant of ADP-beta-1,2-glycosyltransferase"
atgcaccatcatcatgaaggcggtagcggccagaccctgagagtactgatgtttccgtatcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcagcaagcgtgggcagaacaggtcgtgctagaacaggggatcccggctgttaaaattctaaccagtggtgcggcactgtttagctactttttcaacttcctgtctactccgggtgtagagtttccgtttccggcgatcaacctgtcgaagcgagaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag

SEQ ID NO: 3360 - protein, 450 aa, Artificial Sequence
  "Variant of ADP-beta-1,2-glycosyltransferase"
MHHHHEGGSGQTLRVLMFPYLALGHINPFLRIAKQLADRGFLIYLCSTLINLESIKKRIPEKYSNSIHLVELHLPELPELPPHYHTTNGLPPHLNGTLHKALKMSKPNFSKILQNLKPDLVLYDFQQAWAEQVVLEQGIPAVKILTSGAALFSYFFNFLSTPGVEFPFPAINLSKREQVKMREMFEKEPDEEDPLAPGNGGIMLMCTSREIEAKYLDYCTELTNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGRIHRGEIAQVLKDVITGETGEILRGKVRDISKNLRARREEEMNAAAEELIQLCRNRNKYK

SEQ ID NO: 3361 - DNA, 1350 bp, Artificial Sequence
  "Variant of ADP-beta-1,2-glycosyltransferase"
atgcaccatcatcatgaaggcggtagcggccagaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcaagcccaactttagcaagatcctgcaaaacctgaagccggacctggtcctttacgattttcatcaagcgtgggcagaacaggtcgtgctagaacaggggatcccggctgttaaaattctaaccagtggtgcggcactgtttagctactttttcaacttcctgaagggcccgggtgtagagtttccgtttccggcgatcaacctgtcgaagcgagaacaggtgaagatgcgcgagatgtttgaaaaggagccggatgaagaagatccgttagcacctggcgccggaggtatcatgctgatgtgcacgagccgcgaaattgaggctaagtacctggactattgcaccgaactgaccaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagaacattaacgcgaagctgatcgtggaattaggcgttgcagtggagatcgtgcgtgatgaagatggccggattcaccgcggcgaaattgcccaagtccttaaagatgtgattaccggcgaaactggtgagatcctgcgcggcaaagtacgcgacattagcaaaaacctgagagcgagacgcgaggaggaaatgaatgcagcggcggaagaactgatacagctgtgtcgcaaccgcaacaagtacaag
